United States Patent
Kim et al.

(10) Patent No.: US 12,006,502 B2
(45) Date of Patent: Jun. 11, 2024

(54) THERAPEUTIC COMPOUNDS FOR RED BLOOD CELL-MEDIATED DELIVERY OF AN ACTIVE PHARMACEUTICAL INGREDIENT TO A TARGET CELL

(71) Applicants: KIST (Korea Institute of Science and Technology), Seoul (KR); K2B Therapeutics, Inc., Cambridge, MA (US)

(72) Inventors: HoWon J. Kim, Lexington, MA (US); In-San Kim, Seoul (KR); Jay S. Kim, Bedford, MA (US); Sun Hwa Kim, Seoul (KR); Ick Chan Kwon, Seoul (KR); Jong Won Lee, Seoul (KR); Yoo Soo Yang, Seoul (KR); Hong Yeol Yoon, Gyeonggi-do (KR)

(73) Assignees: K2B Therapeutics, Inc., Cambridge, MA (US); KIST (Korea Institute of Science and Technology), Seoul (KR)

( * ) Notice: Subject to any disclaimer, the term of this patent is extended or adjusted under 35 U.S.C. 154(b) by 0 days.

(21) Appl. No.: 18/407,815

(22) Filed: Jan. 9, 2024

(65) Prior Publication Data

US 2024/0150771 A1 May 9, 2024

Related U.S. Application Data

(63) Continuation of application No. 18/057,050, filed on Nov. 18, 2022.

(60) Provisional application No. 63/392,323, filed on Jul. 26, 2022, provisional application No. 63/281,370, filed on Nov. 19, 2021.

(51) Int. Cl.
| | |
|---|---|
| *C12N 15/113* | (2010.01) |
| *A61P 35/00* | (2006.01) |
| *C12Q 1/68* | (2018.01) |

(52) U.S. Cl.
CPC .......... *C12N 15/1138* (2013.01); *A61P 35/00* (2018.01); *C12N 2310/11* (2013.01); *C12N 2310/531* (2013.01)

(58) Field of Classification Search
None
See application file for complete search history.

(56) References Cited

U.S. PATENT DOCUMENTS

| 2021/0015931 A1 | 1/2021 | Kim et al. |
| 2022/0257729 A1 | 8/2022 | Cochran et al. |

FOREIGN PATENT DOCUMENTS

| EP | 3575326 A1 | 12/2019 |
| WO | 2014149477 A1 | 9/2014 |
| WO | 2020163721 A1 | 8/2020 |
| WO | 2021174127 A1 | 9/2021 |

OTHER PUBLICATIONS

Ratnikova et al., "CD47 Receptor as a Primary Target for Cancer Therapy", Molecular Biology, vol. 51, No. 2, pp. 216-225, May 9, 2017.
International Searching Authority—International Search Report, pertaining to International Application No. PCT/US2023/080167 dated May 8, 2023, together with the Written Opinion of the International Searching Authority, 14 pages.
Tatiparti et al., "siRNA Delivery Strategies: A Comprehensive Review of Recent Developments", Nanomaterials, vol. 7, 77, 17 pages, 2017.
Singh et al., "Advances in siRNA delivery in cancer therapy", Artificial Cells, Nanomedicine, and Biotechnology, 46:2, 274-283, 2018.
Resnier et al., "A review of the current status of siRNA nanomedicines in the treatment of cancer", Biomaterials, vol. 34, pp. 6429-6443, 2013.
Boyd et al., "New approaches to genetic therapies for cystic fibrosis", Journal of Cystic Fibrosis, vol. 19, pp. S54-S56, 2020.
Wang et al., "Strategies for short hairpin RNA delivery in cancer gene therapy", Expert Opinion on Biological Therapy, 9:11. pp. 1357-1369, 2009.
Ho et al., "Biomaterials in siRNA Delivery: A Comprehensive Review", Advanced Healthcare Materials, vol. 5, pp. 2715-2731, 2016.
Qureshi et al., "A review on current status of antiviral siRNA", Rev. Med. Virol., vol. 28, 11 pages, 2018.
Kim et al., "Recent progress in development of siRNA delivery vehicles for cancer therapy", Advanced Drug Delivery Reviews, vol. 104, pp. 61-77, 2016.
Yonezawa et al., "Recent advances in siRNA delivery mediated by lipid-based nanoparticles", Advanced Drug Delivery Reviews, vols. 154-155, pp. 64-78, 2020.
Gondi et al., "Concepts in In Vivo siRNA Delivery for Cancer Therapy", Journal of Cellular Physiology, vol. 220, pp. 285-291, 2009.
Ko et al., Versatile activatable vSIRPα-probe for cancer-targeted imaging and macrophage-medicated phagocytosis of cancer cells:, Journal of Controlled Release, vol. 323, pp. 376-386, 2020.
Acharya, "The recent progresses in shRNA-nanoparticle conjugate as a therapeutic approach", Materials Science & Engineering C, vol. 104, 109928, 8 pages, 2019.
Rao et al., "siRNA vs. shRNA: Similarities and differences", Advanced Drug Delivery Reviews, vol. 61, pp. 746-759, 2009.
McLaughlin et al., "CD47 as a potential biomarker for the early diagnosis of severe COVID-19", bioRxiv, 35 pages, 2021.
Cham et al., "Immunotherapeutic Blockade of CD47 Inhibitory Signaling Enhances Innate and Adaptive Immute Responses to Viral Infection", Cell Reports, vol. 31, 107494, 14 pages, Apr. 14, 2020.
Khongorzul et al., Antibody-Drug Conjugates: A Comprehensive Review, Molecular Cancer Research, American Association for Cancer Research Journals, 18 pages, Oct. 28, 2019.

(Continued)

*Primary Examiner* — Sean McGarry
(74) *Attorney, Agent, or Firm* — Sunstein LLP

(57) ABSTRACT

Therapeutic compounds for red blood cell-mediated delivery of an active pharmaceutical ingredient to a target cell are described. The therapeutic compounds are configured to bind CD47 on the surface of a red blood cell and to be subsequently transferred to CD47 on the surface of the target cell, the therapeutic compound ultimately being internalized by the target cell via endocytosis. The target cell may be a fibrotic cell.

8 Claims, 8 Drawing Sheets

Specification includes a Sequence Listing.

(56) References Cited

OTHER PUBLICATIONS

Tan et al., MicroRNAs and cancer: Key paradigms in molecular therapy (Review), Oncology Letters, vol. 15, pp. 2735-2742, 2018.
Gupta et al., "Therapeutic modulation of the CD47-SIRPα axis in the pediatric tumor microenvironment: working up an appetite", Cancer Drug Resist, vol. 3, pp. 550-562, 2020.
Wernig et al., "Unifying mechanism for different fibrotic diseases", PNAS, vol. 14, No. 18, pp. 4757-4762, May 2, 2017.
Cui et al., "Activation of JUN in fibroblasts promotes pro-fibrotic programme and modulates protective immunity", Nature Communications, vol. 11, 2795, 14 pages, 2020.
Wang et al., "Intravenous delivery of siRNA targeting CD47 effectively inhibits melanoma tumor growth and lung metastasis", Molecular Therapy, vol. 21, No. 10, pp. 1919-1929, Oct. 2013.

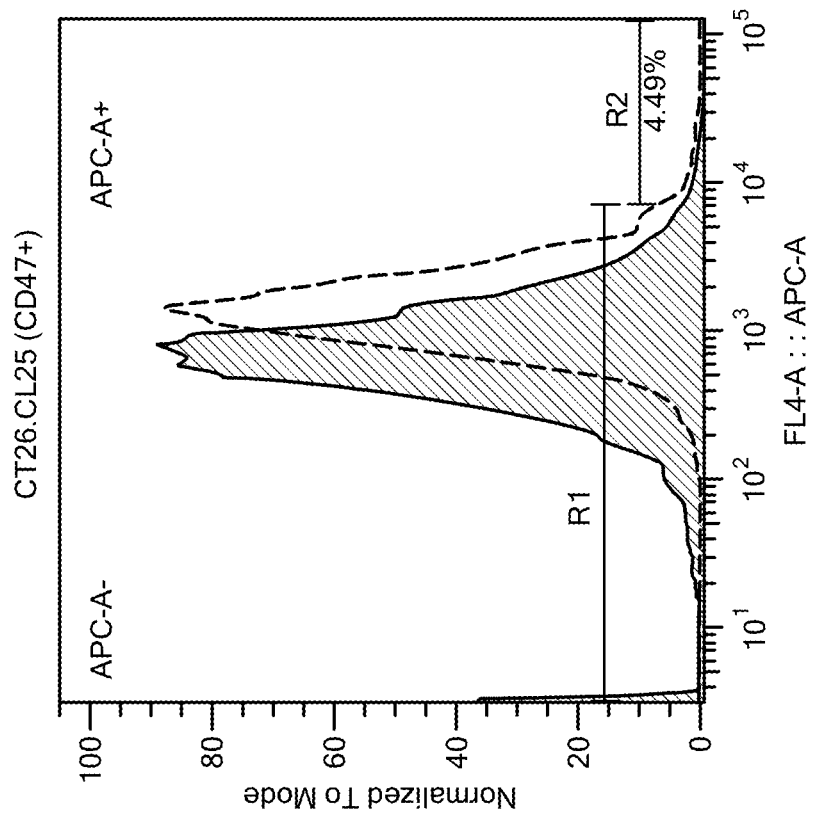
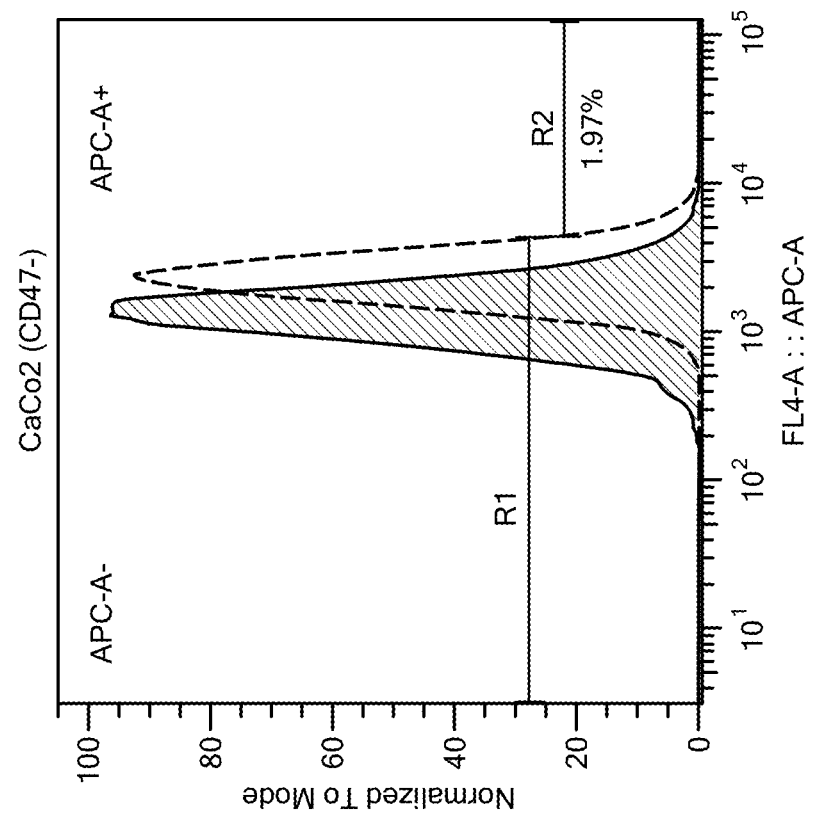
Fig. 3B
Fig. 3A

THERAPEUTIC COMPOUNDS FOR RED BLOOD CELL-MEDIATED DELIVERY OF AN ACTIVE PHARMACEUTICAL INGREDIENT TO A TARGET CELL

CROSS-REFERENCE TO RELATED APPLICATIONS

This application is a continuation of U.S. patent application Ser. No. 18/057,050 filed Nov. 18, 2022, which claims priority from U.S. Provisional Application No. 63/281,370, filed Nov. 19, 2021, and U.S. Provisional Application No. 63/392,323, filed Jul. 26, 2022, each of which is incorporated herein by reference in its entirety.

SEQUENCE LISTING

This application contains a Sequence Listing which has been submitted electronically in XML file format and is hereby incorporated by reference in its entirety. Said XML copy, created on Nov. 17, 2022, is named 4813_1004_SL.xml and is 4,562,889 bytes in size.

TECHNICAL FIELD

The present invention relates generally to a therapeutic compound configured to bind CD47, and more particularly to such a compound configured to bind CD47 on the surface of a red blood cell and to be subsequently transferred to CD47 on the surface of a target cell, the therapeutic compound ultimately being internalized by the target cell via endocytosis.

BACKGROUND ART

Cluster of differentiation 47 ("CD47"), an integrin-associated protein, is a multi-spanning plasma membrane protein involved in the processes inhibiting clearance by phagocytes or neutrophil motility. Signal-regulatory protein alpha ("SIRPα"), a transmembrane protein expressed by innate immune cells such as macrophages and dendritic cells, is the main receptor of CD47. The binding of SIRPα to CD47 triggers SIRPα inhibitory signals, which act as "don't eat me" signals to recipient macrophages, preventing their phagocytic activation. Thus, the SIRPα-CD47 interaction functions as a negative checkpoint for innate and subsequent adaptive immunity. Other proteins, such as signal regulatory protein gamma ("SIRPγ") and thrombospondin-1 ("TSP-1") can also bind CD47, thereby inhibiting aspects of immune response.

Mammalian cells typically express low levels of CD47 to protect them from phagocytosis. However, cancer cells overexpress CD47 as an evasion mechanism to escape immune surveillance and attack by phagocytic cells. Several human solid tumors overexpress CD47, i.e., the cells of these solid tumors express more CD47 than normal cells on average (Willingham et al. *PNAS* 109(17):6662-6667 (2012), which is hereby incorporated by reference in its entirety). CD47 has thus emerged as a promising new therapeutic target for cancer immunotherapy (Willingham et al. *PNAS* 109(17):6662-6667 (2012); Weiskopf, *Eur. J. Cancer* 76:100-109 (2017); Weiskopf et al. *J Clin Invest* 126(7):2610-2620 (2016), each of which is hereby incorporated by reference herein in its entirety).

In addition, virus-infected cells also express high levels of CD47. These virus-infected cells include cells infected with SARS-CoV-2, the virus that causes COVID-19 (Cham et al. *Cell Rep* 14; 31(2):107494 (2020) doi:10.1016/j.celrep.2020.03.058 and McLaughlin et al. *bioRxiv* 2021.03.01.433404 (2021) doi:10.1101/2021.03.01.433404, each of which is hereby incorporated by reference herein in its entirety). Blockade of CD47 inhibitory signaling has been demonstrated to enhance innate and adaptive immune responses to viral infection.

Moreover, increased CD47 expression has been observed in fibrotic fibroblasts and blocking CD47 reverses fibrosis by increasing phagocytosis of profibrotic fibroblasts and by eliminating suppressive effects on adaptive immunity (Cui et al. *Nat Commun* 11:2795 (2020); Wernig et al. *PNAS* 2017; 114(18):4757-62; Boyd *J Cyst Fibros Suppl* 1:S54-S59 (2020); Lerbs et al. *JCI Insight* 2020; 5(16):e140458 (2020), each of which is hereby incorporated by reference herein in its entirety).

CD47, therefore, offers a promising target for the treatment of cancers, viral infections, as well as fibrotic diseases, such as cystic fibrosis.

SUMMARY OF THE EMBODIMENTS

In accordance with one embodiment of the invention, a therapeutic compound for RBC-mediated delivery in a mammalian subject to a target cell expressing CD47, the therapeutic compound comprising: a CD47-binding protein conjugated to an active pharmaceutical ingredient ("API") so as to form a conjugate; wherein the CD47-binding protein is selected from the group consisting of wild type SIRPα (SEQ ID NO: 1), vSIRPα (SEQ ID NO: 3), wild type thrombospondin-1 (TSP-1) (SEQ ID NO: 7), wild type SIRPγ (SEQ ID NO: 4), vSIRPγ-1 (SEQ ID NO: 5), vSIRPγ-2 (SEQ ID NO: 6), ALX148 (SEQ ID NO: 962), TTI-661 (SEQ ID NO: 963), TTI-662 (SEQ ID NO: 964), a homolog of any of the foregoing, and combinations thereof, and is configured to bind the conjugate to CD47 of a red blood cell of the subject so as to enable transport of the conjugate, through the subject's circulatory system, to the target cell, so that (i) the CD47-binding protein, being configured to bind the conjugate to the CD47 of the red blood cell, binds the CD47 of the target cell, thus transferring the conjugate from the red blood cell to the target cell so as to form a conjugate-CD47 complex on the target cell, thereby blocking CD47 and inhibiting CD47 activity as an immune escape mechanism of the target cell, and (ii) the conjugate is taken up by the target cell via endocytosis of the conjugate-CD47 complex, thereby further inhibiting the immune escape mechanism of the target cell and delivering the API into the target cell. The mammalian subject may be a human.

In accordance with another embodiment of the invention, a therapeutic compound for RBC-mediated delivery in a mammalian subject to a target cell expressing CD47, the therapeutic compound comprising: a CD47-binding protein conjugated to an API so as to form a conjugate; wherein the CD47-binding protein is selected from the group consisting of wild type thrombospondin-1 (TSP-1) (SEQ ID NO: 7), wild type SIRPγ (SEQ ID NO: 4), vSIRPγ-1 (SEQ ID NO: 5), vSIRPγ-2 (SEQ ID NO: 6), ALX148 (SEQ ID NO: 962), TTI-661 (SEQ ID NO: 963), TTI-662 (SEQ ID NO: 964), a homolog of any of the foregoing, and combinations thereof, and is configured to bind the conjugate to CD47 of a red blood cell of the subject so as to enable transport of the conjugate, through the subject's circulatory system, to the target cell, so that (i) the CD47-binding protein, being configured to bind the conjugate to the CD47 of the red blood cell, binds the CD47 of the target cell, thus transferring the conjugate from the red blood cell to the target cell so as to form a conjugate-CD47 complex on the target cell, thereby blocking CD47 and inhibiting CD47 activity as an immune escape mechanism of the target cell, and (ii) the conjugate is taken up by the target cell via endocytosis of the conjugate-CD47 complex, thereby further inhibiting the immune escape mechanism of the target cell and delivering the API into the target cell. The mammalian subject may be a human.

In accordance with an embodiment of the invention, a therapeutic compound for RBC-mediated delivery in a mammalian subject to a target cell expressing CD47, the therapeutic compound comprising: a CD47-binding protein conjugated to an API so as to form a conjugate; wherein the CD47-binding protein is an anti-CD47 antibody, the anti-CD47 antibody comprising: (a) a heavy chain variable region including complementarity determining regions CDR1, CDR2, and CDR3 comprising SEQ ID NO: 932, SEQ ID NO: 933, and SEQ ID NO: 934, respectively, and a light chain variable region including complementarity determining regions CDR1, CDR2, and CDR3 comprising SEQ ID NO: 935, SEQ ID NO: 936, and SEQ ID NO: 937, respectively; (b) a heavy chain variable region including complementarity determining regions CDR1, CDR2, and CDR3 comprising SEQ ID NO: 940, SEQ ID NO: 941, and SEQ ID NO: 942, respectively, and a light chain variable region including complementarity determining regions CDR1, CDR2, and CDR3 comprising SEQ ID NO: 943, SEQ ID NO: 944, and SEQ ID NO: 945, respectively; (c) a heavy chain variable region including complementarity determining regions CDR1, CDR2, and CDR3 comprising SEQ ID NO: 948, SEQ ID NO: 949, and SEQ ID NO: 950, respectively, and a light chain variable region including complementarity determining regions CDR1, CDR2, and CDR3 comprising SEQ ID NO: 951, SEQ ID NO: 952, and SEQ ID NO: 953, respectively; or (d) a heavy chain variable region including complementarity determining regions CDR1, CDR2, and CDR3 comprising SEQ ID NO: 956, SEQ ID NO: 957, and SEQ ID NO: 958, respectively, and a light chain variable region including complementarity determining regions CDR1, CDR2, and CDR3 comprising SEQ ID NO: 959, SEQ ID NO: 960, and SEQ ID NO: 961, respectively; and being configured to bind the conjugate to CD47 of a red blood cell of the subject so as to enable transport of the conjugate, through the subject's circulatory system, to the target cell, so that (i) the CD47-binding protein, being configured to bind the conjugate to the CD47 of the red blood cell, binds the CD47 of the target cell, thus transferring the conjugate from the red blood cell to the target cell so as to form a conjugate-CD47 complex on the target cell, thereby blocking CD47 and inhibiting CD47 activity as an immune escape mechanism of the target cell, and (ii) the conjugate is taken up by the target cell via endocytosis of the conjugate-CD47 complex, thereby further inhibiting the immune escape mechanism of the target cell and delivering the API into the target cell. The mammalian subject may be a human.

The CD47-binding protein may be conjugated to the API by a bond selected from the group consisting of a covalent bond, a hydrogen bond, an ionic bond, a van der Waals interaction, and combinations thereof. The CD47-binding protein may be conjugated to the API by a linker and the linker may be cleavable. The linker may be configured to be cleaved by a lysosomal degradative enzyme.

In some embodiments, the API is selected from the group consisting of RNA, DNA, an RNA derivative, a DNA derivative, a protein, and a small molecule. The RNA may be selected from the group consisting of siRNA, shRNA, miRNA, antimiR, and mRNA.

The target cell may be a cell selected from the group consisting of a cancer cell, a virus infected cell, a fibrotic cell, and combinations thereof. In some embodiments, the target cell is a cancer cell. In some embodiments, the target cell is a virus-infected cell. In some embodiments, the target cell is a fibrotic cell.

In some embodiments, the cancer cell is in a tumor attributable to a cancer selected from the group consisting of brain tumor, spinal cord tumor, retinoblastoma, oral cancer, nasal cavity cancer, paranasal sinus cancer, pharyngeal cancer, laryngeal cancer, neck cancer, head and neck cancer, melanoma, skin cancer, breast cancer, thyroid cancer, malignant adrenal tumor, endocrine cancer, lung cancer, pleural tumor, respiratory tract cancer, esophageal cancer, stomach cancer, small intestine cancer, colon cancer, anal cancer, liver cancer, biliary tract cancer, pancreatic cancer, kidney cancer, bladder cancer, prostate cancer, testicular cancer, penile cancer, cervical cancer, endometrial cancer, choriocarcinoma, ovarian cancer, blood cancer including acute/chronic leukemia, malignant lymphoma and multiple myeloma, bone tumor, soft tissue tumor, childhood leukemia, and childhood cancer.

In some embodiments, the cancer cell is attributable to a cancer selected from the group consisting of ovarian serous cystadenocarcinoma, lung adenocarcinoma, cervical and endocervical cancer, head and neck squamous cell carcinoma, thyroid carcinoma, uterine corpus endometrioid carcinoma, prostate adenocarcinoma, mesothelioma, diffuse large B-cell lymphoma, acute leukemia, lung squamous cell carcinoma, acute lymphoblastic leukemia, esophageal carcinoma, myxofibrosarcoma, pancreatic adenocarcinoma, rectum adenocarcinoma, colon adenocarcinoma, acute megakaryoblastic leukemia, breast invasive carcinoma, stomach adenocarcinoma, bladder urothelial carcinoma, cholangiocarcinoma, leukemia, thymic carcinoma, leiomyosarcoma, thymoma, undifferentiated pleomorphic sarcoma, uterine carcinosarcoma, acute myeloid leukemia, glioblastoma multiforme, sarcoma, skin cutaneous melanoma, kidney clear cell carcinoma, dedifferentiated liposarcoma, lymphoma, retinoblastoma, neuroblastoma, osteosarcoma, juvenile myelomonocytic leukemia, gastrointestinal stromal tumor, dysembryoplatic neuroepithelial tumor, adrenocortical cancer, acute leukemia of ambiguous lineage, pheochromocytoma and paraganglioma, glioma, testicular germ cell tumor, supratentorial embryonal tumor NOS, neurofibroma, kidney papillary cell carcinoma, hepatocellular carcinoma, kidney chromophobe, malignant peripheral nerve sheath tumor, ependymoma, adrenocortical carcinoma, nasopharyngeal carcinoma, spindle cells/sclerosing rhabdomyosarcoma, melanoma, choroid plexus carcinoma, undifferentiated spindle cell carcinoma, myoepithelial carcinoma, alveolar rhabdomyosarcoma, rhabdomyosarcoma, atypical teratoid/rhabdoid tumor, desmoplastic small round cell tumor, fibromatosis, synovial sarcoma, wilms tumor, myofibromytosis, fibrolamellar hepatocellular carcinoma, undifferentiated sarcoma NOS, embryonal rhabdomyosarcoma, uveal melanoma, Ewing sarcoma, hepatoblastoma, infantile fibrosarcoma, INI-deficient soft tissue sarcoma NOA, undifferentiated hepatic sarcoma, and medulloblastoma.

In some embodiments, the virus-infected cell is infected with a SARS-CoV-2 virus. In some embodiments, the fibrotic cell is associated with cystic fibrosis.

In some embodiments, the API is siRNA, the siRNA being a double-stranded RNA molecule including an antisense RNA strand and a sense RNA strand, wherein: (a) the antisense RNA strand is 19-29 nucleotides in length and is complementary to contiguous nucleotides in a target mammalian mRNA sequence, the mRNA sequence being selected from the group consisting of SEQ ID NO: 8-747 and 771-824, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length. In other embodiments, the mRNA sequence is selected from the group consisting of SEQ ID NO: 22-747 and 771-824. In some embodiments, the mRNA sequence is selected from the group consisting of SEQ ID NO: 22-37. In other embodiments, the mRNA sequence is selected from the group consisting of SEQ ID NO: 38-39. In some embodiments, the mRNA sequence is selected from the group consisting of SEQ ID NO: 40-43. In other embodiments, the mRNA sequence is selected from the group consisting of SEQ ID NO: 44-51.

In some embodiments, the API is siRNA, the siRNA being a double-stranded RNA molecule including an antisense RNA strand and a sense RNA strand, wherein: (a) the antisense RNA strand is 19-29 nucleotides in length and is complementary to contiguous nucleotides in a target mammalian mRNA sequence, the mRNA sequence being selected from the group consisting of SEQ ID NO: 8-21, 482-486, and 748-765, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length. In other embodiments, the mRNA sequence is selected from the group consisting of SEQ ID NO: 482-486 and 748-765.

In some embodiments, the API is siRNA, the siRNA being a double-stranded RNA molecule including an antisense RNA strand and a sense RNA strand, wherein: (a) the antisense RNA strand is 19-29 nucleotides in length and is complementary to contiguous nucleotides in a target mammalian mRNA sequence, the mRNA sequence being selected from the group consisting of SEQ ID NO: 8-21, 40-43, and 766-770, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length. In other embodiments, the mRNA sequence is selected from the group consisting of SEQ ID NO: 40-43 and 766-770.

The API is shRNA, the shRNA being a single-stranded RNA molecule of 44-71 nucleotides in length, and having, in a 5' to 3' direction: a first region of 19-29 nucleotides at the 5' end of the single-stranded RNA molecule, the first region having a first sequence; a second region of 4-11 nucleotides directly adjacent to the first region, the second region having a second sequence; a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein: (a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 8-747 and 771-824, and (d) the single-stranded RNA molecule is configured to form a stem loop structure, the first region base pairing with the third region to form a stem, the second region forming a loop, and the fourth region forming a 3' overhang. In other embodiments, the mRNA sequence is selected from the group consisting of SEQ ID NO: 22-747 and 771-824. In some embodiments, the mRNA sequence is selected from the group consisting of SEQ ID NO: 22-37. In other embodiments, the mRNA sequence is selected from the group consisting of SEQ ID NO: 38-39. In some embodiments, the mRNA sequence is selected from the group consisting of SEQ ID NO: 40-43. In other embodiments, the mRNA sequence is selected from the group consisting of SEQ ID NO: 44-51.

In some embodiments, the API is shRNA, the shRNA being a single-stranded RNA molecule of 44-71 nucleotides in length, and having, in a 5' to 3' direction: a first region of 19-29 nucleotides at the 5' end of the single-stranded RNA molecule, the first region having a first sequence; a second region of 4-11 nucleotides directly adjacent to the first region, the second region having a second sequence; a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein: (a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 8-21, 482-486, and 748-765, and (d) the single-stranded RNA molecule is configured to form a stem loop structure, the first region base pairing with the third region to form a stem, the second region forming a loop, and the fourth region forming a 3' overhang. In other embodiments, the mRNA sequence is selected from the group consisting of SEQ ID NO: 482-486 and 748-765.

In some embodiments, the API is shRNA, the shRNA being a single-stranded RNA molecule of 44-71 nucleotides in length, and having, in a 5' to 3' direction: a first region of 19-29 nucleotides at the 5' end of the single-stranded RNA molecule, the first region having a first sequence; a second region of 4-11 nucleotides directly adjacent to the first region, the second region having a second sequence; a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein: (a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 8-21, 40-43, and 766-770, and (d) the single-stranded RNA molecule is configured to form a stem loop structure, the first region base pairing with the third region to form a stem, the second region forming a loop, and the fourth region forming a 3' overhang. In other embodiments, the mRNA sequence is selected from the group consisting of SEQ ID NO: 40-43 and 766-770.

In some embodiments, the API is an miRNA selected from the group consisting of SEQ ID NO: 825-844, 849-851, 853, 855, 857, 864, 865, and 867-883.

In some embodiments, the API is an antimiR, the antimiR being a single-stranded nucleic acid molecule of 12-25 nucleotides in length, the antimiR having a sequence of 12-25 contiguous nucleotides that is complementary to contiguous nucleotides in a target mature miRNA product sequence, the mature miRNA product sequence being selected from the group consisting of SEQ ID NO: 884-908, wherein the contiguous nucleotides in the mature miRNA product sequence includes, in a 5' to 3' direction, nucleotides 2 to 8 of the mature miRNA product sequence.

In some embodiments, the API is a small molecule selected from the group consisting of methotrexate; doxorubicin; vinca alkaloids; camptothecin analogues; microtubule-disrupting agents such as auristatins (e.g., MMAE and MMAF) and maytansinoids (e.g., DM1 and DM4); and DNA-damaging agents such as DNA topoisomerase I inhibitors (e.g., SN-38 and exatecan), double-strand break agents (e.g., calicheamicin), cross-linkers (e.g., pyrrolobenzodiazepine dimer-PBD), and alkylators (e.g., duocarmycin and indolinobenzodiazepine dimer-IGN).

In some embodiments, the API is a protein, the protein having an amino acid sequence selected from the group consisting of SEQ ID NO: 909-929 and homologs thereof. In other embodiments, the protein consists of an amino acid sequence selected from the group consisting of SEQ ID NO: 909-929 and homologs thereof.

In some embodiments, the API is an mRNA encoding an amino acid sequence selected from the group consisting of SEQ ID NO: 909-929 and homologs thereof, the mRNA being configured to be translated in the target cell to produce a protein comprising the amino acid sequence. In other embodiments, the mRNA is configured to be translated in the target cell to produce a protein consisting of the amino acid sequence. In some embodiments, the mRNA is codon optimized.

In accordance with one embodiment of the invention, a method of treating cancer in a mammalian subject in need thereof, the method comprising administering a therapeutically effective amount of a therapeutic compound described herein. The mammalian subject may be a human.

In accordance with another embodiment of the invention, a method of treating viral infection in a mammalian subject in need thereof, the method comprising administering a therapeutically effective amount of a therapeutic compound described herein. The mammalian subject may be a human.

In accordance with an embodiment of the invention, a method of treating fibrotic disease in a mammalian subject in need thereof, the method comprising administering a therapeutically effective amount of a therapeutic compound described herein. The mammalian subject may be a human.

In accordance with another embodiment of the invention, a pharmaceutical composition comprising a therapeutic compound described herein.

BRIEF DESCRIPTION OF THE DRAWINGS

The foregoing features of embodiments will be more readily understood by reference to the following detailed description, taken with reference to the accompanying drawings, in which:

Figures 1A, 1B:
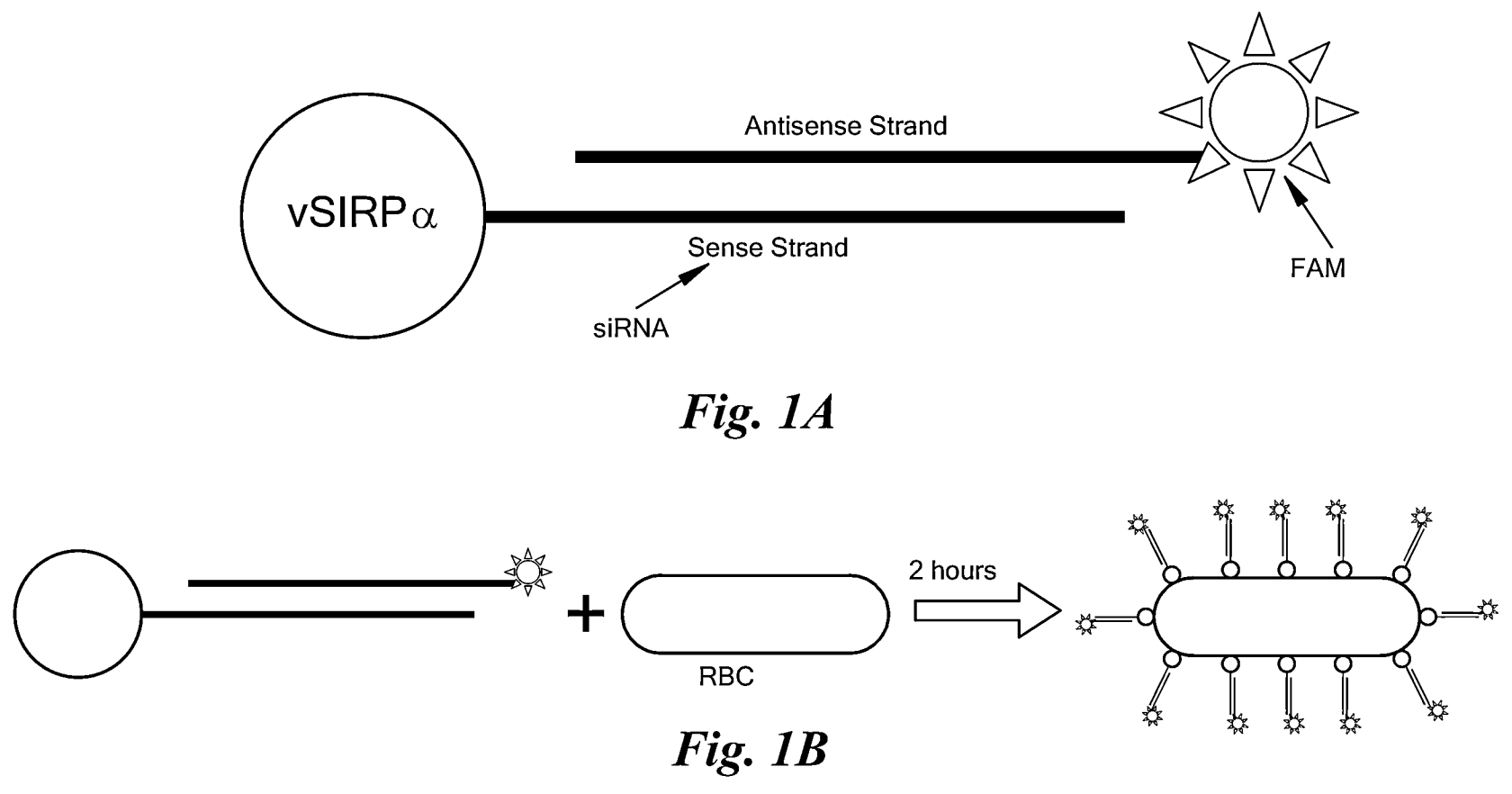

FIG. 1A illustrates a FAM-tagged vSIRPα-siRNA conjugate in accordance with embodiments of the invention. FIG. 1B is an illustration of the incubation of red blood cells with the FAM-tagged vSIRPα-siRNA conjugate of FIG. 1A.

FIG. 3A shows flow cytometry results of CaCO2 cells before and after being incubated with red blood cells bound with an Alexa Fluor® 647 anti-mouse CD47 monoclonal antibody, in accordance with embodiments of the invention. FIG. 3B shows flow cytometry results of CT26.CL25 cells before and after being incubated with red blood cells bound with an Alexa Fluor® 647 anti-mouse CD47 monoclonal antibody.

DETAILED DESCRIPTION OF SPECIFIC EMBODIMENTS

Figure 1C:
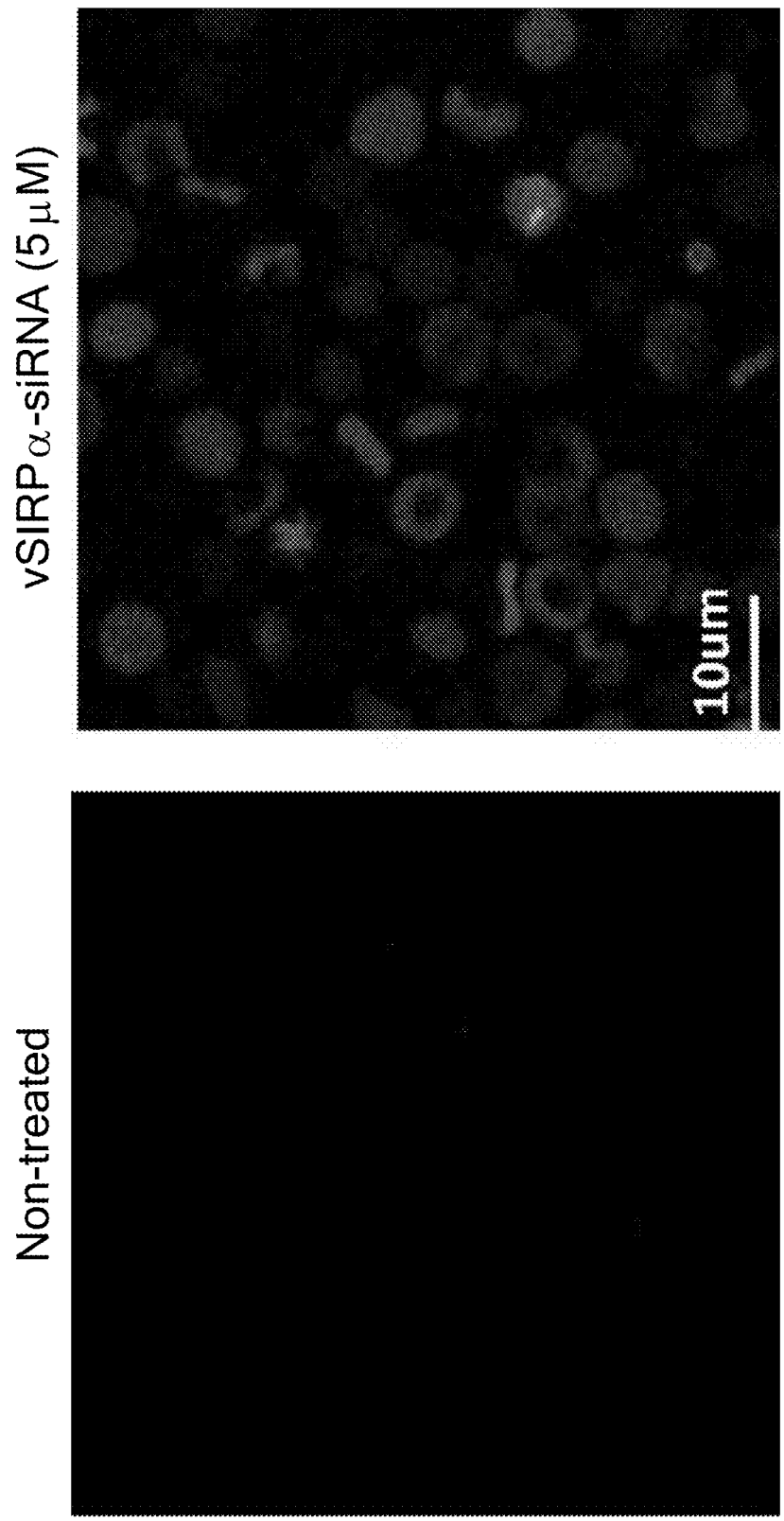
FIG. 1C shows fluorescence microscopy images of red blood cells that were not incubated with the FAM-tagged vSIRPα-siRNA conjugate shown in FIG. 1A (left) and red blood cells that were incubated with the FAM-tagged vSIRPα-siRNA conjugate shown in FIG. 1A (right).

As used in this description and the accompanying claims, the following terms shall have the meanings indicated, unless the context otherwise requires:

The terms "a" and "an" and "the" and similar reference used in the context of describing the invention (especially in the context of the claims) are to be construed to cover both the singular and the plural, unless otherwise indicated herein or clearly contradicted by context. Recitation of ranges of values herein is merely intended to serve as a shorthand method of referring individually to each separate value falling within the range. Unless otherwise indicated herein, each individual value is incorporated into the specification as if it were individually recited herein. No language in the specification should be construed as indicating any non-claimed element essential to the practice of the invention A "set" includes at least one member.

The term "mammal," and the like, refers to any animal species of the Mammalian class. Examples of mammals include humans; laboratory animals such as rats, mice, simians and guinea pigs; domestic animals such as rabbits, cattle, sheep, goats, cats, dogs, horses, pigs, and the like.

"Active pharmaceutical ingredient," "API," and the like, means the non-CD47-binding protein portion and the non-linker portion of a therapeutic compound, in accordance with embodiments of the invention, that is biologically active. Suitable active pharmaceutical ingredients ("APIs") include RNA (siRNA, miRNA, shRNA, and mRNA), DNA, antimiR oligonucleotides (RNA, DNA, and derivatives thereof), RNA and DNA derivatives (including, but not limited to, modified RNA and DNA comprising a modified backbone, sugar, and/or base), proteins, and small molecules.

As used herein, a "homolog" of a given protein, and the like, shall mean a protein having at least 95% sequence identity with the given protein.

"Complementarity," as used herein regarding nucleic acid sequences, refers to the ability of a nucleic acid to forms hydrogen bonds with another nucleic acid sequence by Watson-Crick base pairing or wobble base pairing. A percent complementarity indicates the percentage of nucleotides in a nucleic acid molecule that can form hydrogen bonds (e.g., Watson-Crick base pairing) with the nucleotides of a second nucleic acid sequence (e.g., 5, 6, 7, 8, 9, 10 out of 10 being 50%, 60%, 70%, 80%, 90%, and 100% complementarity). "Perfectly complementary," and the like, means that all the contiguous nucleotides of a nucleic acid sequence will hydrogen bond with the same number of contiguous nucleotides in a second nucleic acid sequence (i.e., the nucleic acid sequence has 100% complementarity). "Complementary," as used herein without further qualification, means that contiguous nucleotides of a nucleic acid sequence has a percent complementarity with contiguous nucleotides of a second nucleic acid sequence that is selected from the group consisting of 95%, 96%, 97%, 98%, 99%, and 100% complementarity over a region of 12, 13, 14, 15, 16, 17, 18, 19, 20, 21, 22, 23, 24, 25, 26, 27, 28, 29, or more nucleotides of the nucleic acid sequence. For example, a nucleic acid sequence that is 19 nucleotides in length and complementary to 14 nucleotides of a second nucleic acid sequence means that 14 contiguous nucleotides of the nucleic acid sequence has a percent complementarity with contiguous nucleotides of the second nucleic acid sequence that is selected from the group consisting of 95%, 96%, 97%, 98%, 99%, and 100% complementarity. A nucleic acid sequence that is 19 nucleotides in length and complementary to contiguous nucleotides in a second nucleic acid sequence means that 19 contiguous nucleotides of the nucleic acid sequence has a percent complementarity with contiguous nucleotides of the second nucleic acid sequence that is selected from the group consisting of 95%, 96%, 97%, 98%, 99%, and 100% complementarity.

"Codon-optimized" means that the coding sequence of an mRNA transcript contains the most or second most preferred codon, for the species of a given target cell/host cell, for at least 60% of the codons of the coding sequence such that the codon-optimized sequence is more efficiently translated in the target cell/host cell relative to a non-optimized sequence.

The term "antibody" refers to an immunoglobulin molecule that is typically composed of two identical pairs of polypeptide chains, each pair having one "heavy" (H) chain and one "light" (L) chain. Human light chains are classified as kappa (κ) and lambda (λ). Heavy chains are classified as mu, delta, gamma, alpha, or epsilon, and define the antibody's isotype as IgM, IgD, IgG, IgA, and IgE, respectively. Each heavy chain is comprised of a heavy chain variable region (VH) and a heavy chain constant region. The heavy chain constant regions of IgD, IgG, and IgA are comprised of three domains, CH1, CH2 and CH3, and the heavy chain constant regions of IgM and IgE are comprised of four domains, CH1, CH2, CH3, and CH4. Each light chain is comprised of a light chain variable region (VL) and a light chain constant region. The light chain constant region is comprised of one domain, CL. The constant regions of the antibodies may mediate the binding of the immunoglobulin to host tissues or factors, including various cells of the immune system (e.g., effector cells). The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from the amino-terminus to carboxy-terminus in the following order: FR1, CDR1, FR2, CDR2, FR3, CDR3, FR4. The variable regions of each heavy/light chain pair (VH/VL) typically form an antibody's antigen-binding site. The term "antibody" is not limited by any particular method of producing the antibody. For example, it includes monoclonal antibodies, recombinant antibodies, and polyclonal antibodies.

The term "human antibody" refers to an antibody consisting of amino acid sequences of human immunoglobulin sequences only. A human antibody may contain murine carbohydrate chains if produced in a mouse, in a mouse cell or in a hybridoma derived from a mouse cell. Human antibodies may be prepared in a variety of ways known in the art.

The term "humanized antibody" refers to an antibody that contains some or all of the CDRs from a non-human animal antibody, while the framework and constant regions of the antibody contain amino acid residues derived from human antibody sequences. Humanized antibodies are typically produced by grafting CDRs from a mouse antibody into human framework sequences followed by back substitution of certain human framework residues for the corresponding mouse residues from the source antibody. The term "humanized antibody" also refers to an antibody of non-human origin in which, typically in one or more variable regions, one or more epitopes have been removed that have a high propensity of constituting a human T-cell and/or B-cell epitope, for purposes of reducing immunogenicity. The amino acid sequence of the epitope can be removed in full or in part. However, typically the amino acid sequence is altered by substituting one or more of the amino acids constituting the epitope for one or more other amino acids, thereby changing the amino acid sequence into a sequence that does not constitute a human T-cell and/or B-cell epitope. The amino acids are substituted by amino acids that are present at the corresponding position(s) in a corresponding human variable heavy or variable light chain as the case may be.

The term "pharmaceutically acceptable carrier" means solvents, carrier agents, diluting agents and the like which are usually used in the administration of pharmaceutical compounds.

CD47 is overexpressed in various cancer cells, in virus-infected cells, and in fibrotic cells, offering a promising target for the treatment of various cancers, viral infections, and fibrotic diseases. By blocking CD47 signaling in these cells, and even the expression of CD47 itself, these cells' evasion of the immune system can be suppressed, allowing for their elimination and the subsequent recovery of a patient from disease.

For example, intravenous injection of a variant SIRPα ("vSIRPα"), having high affinity for CD47 and conjugated to a probe, has been found to be taken up by tumorigenic cells of mice. In addition, vSIRPα, conjugated to a siRNA targeting CD47, has been shown to enhance phagocytosis of CT26.CL25 cancer cells in culture (Ko et al. *Control Release* 323:376-386 (2020) and U.S. Publication No. 2021/0015931, each of which is hereby incorporated by reference herein in its entirety).

We have unexpectedly found that CD47 present on the cell surface of red blood cells ("RBC") and on the cell surface of target cells, such as cancer cells, virus-infected cells, and fibrotic cells, can be utilized to deliver various APIs to said target cells via a novel mechanism.

Here, we describe novel therapeutic compounds for RBC-mediated delivery of an API to a target cell expressing CD47 in a mammalian subject. The therapeutic compound is a conjugate comprising a CD47-binding protein conjugated to an API. The CD47-binding protein of the conjugate binds the conjugate to CD47 present on the surface of the subject's red blood cells, thereby allowing transport of the conjugate through the subject's circulatory system to the target cell. The conjugate is transferred from the RBC to CD47 present on the surface of the target cell. Upon binding of the conjugate to CD47 of the target cell, the ability of the target cell to evade attack by the subject's immune system is reduced. Furthermore, upon binding of the conjugate to CD47 of the target cell, the conjugate-CD47 complex is internalized via endocytosis, further reducing the ability of the target cell to evade attack by the subject's immune system, and delivering the API into the target cell. Surprisingly, when the conjugate is bound to CD47 on the surface of the RBC, the conjugate-CD47 is not internalized by the RBC. In some embodiments, the mammalian subject is a human.

The CD47-binding protein may be conjugated to the API by a linker. A linker connects a CD47-binding protein to an API. The linker may be a cleavable linker that is cleaved upon internalization of conjugate by the target cell, thereby releasing the API from the CD47-binding protein In some embodiments, the target cell is a cancer cell and the therapeutic compound may be used to treat a cancer in a mammalian subject.

The cancer cell may be in a tumor attributable to a cancer selected from the group consisting of brain tumor, spinal cord tumor, retinoblastoma, oral cancer, nasal cavity cancer, paranasal sinus cancer, pharyngeal cancer, laryngeal cancer, neck cancer, head and neck cancer, melanoma, skin cancer, breast cancer, thyroid cancer, malignant adrenal tumor, endocrine cancer, lung cancer, pleural tumor, respiratory tract cancer, esophageal cancer, stomach cancer, small intestine cancer, colon cancer, anal cancer, liver cancer, biliary tract cancer, pancreatic cancer, kidney cancer, bladder cancer, prostate cancer, testicular cancer, penile cancer, cervical cancer, endometrial cancer, choriocarcinoma, ovarian cancer, blood cancer including acute/chronic leukemia, malignant lymphoma and multiple myeloma, bone tumor, soft tissue tumor, childhood leukemia, and childhood cancer.

The cancer cell may attributable to a cancer selected from the group consisting of ovarian serous cystadenocarcinoma, lung adenocarcinoma, cervical and endocervical cancer, head and neck squamous cell carcinoma, thyroid carcinoma, uterine corpus endometrioid carcinoma, prostate adenocarcinoma, mesothelioma, diffuse large B-cell lymphoma, acute leukemia, lung squamous cell carcinoma, acute lymphoblastic leukemia, esophageal carcinoma, myxofibrosarcoma, pancreatic adenocarcinoma, rectum adenocarcinoma, colon adenocarcinoma, acute megakaryoblastic leukemia, breast invasive carcinoma, stomach adenocarcinoma, bladder urothelial carcinoma, cholangiocarcinoma, leukemia, thymic carcinoma, leiomyosarcoma, thymoma, undifferentiated pleomorphic sarcoma, uterine carcinosarcoma, acute myeloid leukemia, glioblastoma multiforme, sarcoma, skin cutaneous melanoma, kidney clear cell carcinoma, dedifferentiated liposarcoma, lymphoma, retinoblastoma, neuroblastoma, osteosarcoma, juvenile myelomonocytic leukemia, gastrointestinal stromal tumor, dysembryoplatic neuroepithelial tumor, adrenocortical cancer, acute leukemia of ambiguous lineage, pheochromocytoma and paraganglioma, glioma, testicular germ cell tumor, supratentorial embryonal tumor NOS, neurofibroma, kidney papillary cell carcinoma, hepatocellular carcinoma, kidney chromophobe, malignant peripheral nerve sheath tumor, ependymoma, adrenocortical carcinoma, nasopharyngeal carcinoma, spindle cells/sclerosing rhabdomyosarcoma, melanoma, choroid plexus carcinoma, undifferentiated spindle cell carcinoma, myoepithelial carcinoma, alveolar rhabdomyosarcoma, rhabdomyosarcoma, atypical teratoid/rhabdoid tumor, desmoplastic small round cell tumor, fibromatosis, synovial sarcoma, wilms tumor, myofibromytosis, fibrolamellar hepatocellular carcinoma, undifferentiated sarcoma NOS, embryonal rhabdomyosarcoma, uveal melanoma, Ewing sarcoma, hepatoblastoma, infantile fibrosarcoma, INI-deficient soft tissue sarcoma NOA, undifferentiated hepatic sarcoma, and medulloblastoma. See Gupta et al. *Cancer Drug Resist* 3:550-62 (2020), which is hereby incorporated by reference herein in its entirety.

In other embodiments, the target cell is a virus-infected cell and the therapeutic compound may be used to treat a viral infection in a mammalian subject. The virus-infected cell may be infected with the SARS-CoV-2 virus.

In some embodiments, the target cell is a fibrotic cell and the therapeutic compound may be used to treat a fibrotic disease in a mammalian subject. The fibrotic cell may be a fibrotic fibroblast. In some embodiments, the fibrotic disease is cystic fibrosis.

CD47-Binding Proteins

Suitable CD47-binding proteins for the conjugates described herein include wild type ("wt") SIRPα (SEQ ID NO:1), variant SIRPα ("vSIRPα") (SEQ ID NO:3), wt TSP-1 (SEQ ID NO:7), wt SIRPγ (SEQ ID NO:4), variant SIRPγ-1 ("vSIRPγ-1") (SEQ ID NO:5), variant SIRPγ-2 ("vSIRPγ-2") (SEQ ID NO:6), and homologs of any of the foregoing. ALX148 (SEQ ID NO: 962), TTI-661 (SEQ ID NO: 963), TTI-662 (SEQ ID NO: 964), and homologs thereof are also suitable CD47-binding proteins for the conjugates described herein. ALX148 is a SIRPα D1 variant fused to an Fc domain monomer. See, e.g., U.S. Pat. No. 10,696,730, which is hereby incorporated by reference herein in its entirety. TTI-661 is an IgV domain of human SIRPα variant 2 fused to a constant region of human IgG1 antibody, and TTI-662 is an IgV domain of human SIRPα variant 2 fused to a constant region of human IgG4 antibody. See, e.g., U.S. Pat. No. 9,969,789, which is hereby incorporated by reference herein in its entirety.

Other suitable CD47-binding proteins include anti-CD47 antibodies.

In some embodiments, the CD47-binding protein is an anti-CD47 antibody, such as B6H12, 5F9, 8B6, C3, and Hu5F9-G4, described in U.S. Pat. Nos. 9,017,675 and 9,623,079, each of which is hereby incorporated by reference herein in its entirety.

In some embodiments, the anti-CD47 antibody includes a heavy chain variable region comprising SEQ ID NO: 930 and a light chain variable region comprising SEQ ID NO: 931. In some embodiments, the anti-CD47 antibody includes a heavy chain variable region comprising SEQ ID NO: 938 and a light chain variable region comprising SEQ ID NO: 939. In some embodiments, the anti-CD47 antibody includes a heavy chain variable region comprising SEQ ID NO: 946 and a light chain variable region comprising SEQ ID NO: 947. In some embodiments, the anti-CD47 antibody includes a heavy chain variable region comprising SEQ ID NO: 954 and a light chain variable region comprising SEQ ID NO: 955.

In some embodiments, the anti-CD47 antibody comprises a heavy chain variable region including complementarity determining regions CDR1, CDR2, and CDR3 comprising SEQ ID NO: 932, SEQ ID NO: 933, and SEQ ID NO: 934, respectively, and a light chain variable region including complementarity determining regions CDR1, CDR2, and CDR3 comprising SEQ ID NO: 935, SEQ ID NO: 936, and SEQ ID NO: 937, respectively.

In some embodiments, the anti-CD47 antibody comprises a heavy chain variable region including complementarity determining regions CDR1, CDR2, and CDR3 comprising SEQ ID NO: 940, SEQ ID NO: 941, and SEQ ID NO: 942, respectively, and a light chain variable region including complementarity determining regions CDR1, CDR2, and CDR3 comprising SEQ ID NO: 943, SEQ ID NO: 944, and SEQ ID NO: 945, respectively.

In some embodiments, the anti-CD47 antibody comprises a heavy chain variable region including complementarity determining regions CDR1, CDR2, and CDR3 comprising SEQ ID NO: 948, SEQ ID NO: 949, and SEQ ID NO: 950, respectively, and a light chain variable region including complementarity determining regions CDR1, CDR2, and CDR3 comprising SEQ ID NO: 951, SEQ ID NO: 952, and SEQ ID NO: 953, respectively.

In some embodiments, the anti-CD47 antibody comprises a heavy chain variable region including complementarity determining regions CDR1, CDR2, and CDR3 comprising SEQ ID NO: 956, SEQ ID NO: 957, and SEQ ID NO: 958, respectively, and a light chain variable region including complementarity determining regions CDR1, CDR2, and CDR3 comprising SEQ ID NO: 959, SEQ ID NO: 960, and SEQ ID NO: 961, respectively.

In some embodiments, the anti-CD47 antibody is a human antibody. In some embodiments, the anti-CD47 antibody is a humanized antibody.

Each of these CD47-binding proteins binds to CD47 present on the surface of a target cell.

In some embodiments, a CD47-binding protein is conjugated to an API by a bond selected from the group consisting of a covalent bond, a hydrogen bond, an ionic bond, a van der Waals interaction, and combinations thereof. Examples of linkers that covalently bond a CD47-binding protein to an API are described below.

Linkers

Suitable linkers include, but are not limited to, cleavable linkers such as hydrazone linkers, imine linkers, oxime linkers, carbonate linkers, acetal linkers, orthoester linkers, silyl ether linkers, disulfide linkers, trioxolane linkers, beta-glucuronide linkers, beta-galactoside linkers, pyrophosphate linkers, phosphoramidate linkers, arylsulfate linkers, heptamethine cyanine linkers, nitrobenzyl linkers, aryl boronic acid linkers, boronate linkers, thioether linkers, maleimidocaproyl-containing linkers, enzyme-cleavable peptide linkers, and para-amino benzyl carbamate-containing linkers, as well as non-cleavable linkers such as polyethylene glycol.

The CD47-binding protein-API conjugates described herein may be made by joining the CD47-binding protein to the API via a linker using coupling reactions such as bis(vinylsulfonyl)piperazine-disulfide coupling, N-methyl-N-phenylvinylsulfonamide-cysteine coupling, platinum (II) compound-histidine coupling, and tetrazine-trans-cyclooctene coupling. Suitable linkers and coupling reactions are known to those of skill in art. See, e.g., Su et al. *Acta Pharmaceutica Sinica B* (2021), ISSN 2211-3835; Pan et al. *Med Res Rev.* 40:2682-2713 (2020); Khongorzul et al. *Mol Cancer Res* 18:3-19 (2020); Bargh et al. *Chem Soc Rev* 48:4361-4374 (2019); and Smith et al. *Pharm Res* 32:3526-3540 (2015), each of which is hereby incorporated by reference herein in its entirety.

Various enzyme-cleavable peptide linkers, such as those described below, can be used to couple a CD47-binding protein to an API to form a CD47-binding protein-API conjugate, in accordance with embodiments of the invention. These linkers comprise amino acid residues and are cleaved by specific enzymes within a cell, such as lysosomal degradative enzymes. See, e.g., Kong et al. *J Biol Chem* 290:7160-7168 (2015); Poreba *FEBS J* 287:1936-1969 (2020); and Singh et al., *Current Medicinal Chemistry* 15(18) (2008), each of which is hereby incorporated by reference herein in its entirety. Exemplary peptide linkers suitable for use in accordance with embodiments of the invention are described below.

For example, di-peptide linkers are comprised of two amino acid residues that serve as a recognition motif for cleavage by the enzyme cathepsin B, which cleaves the amide bond after the second amino acid residue between the carbonyl and amine. Di-peptide linkers cleaved by cathepsin B include Phe-Arg, Phe-Cit, Phe-Lys, Ala-Arg, Ala-Cit, Val-Ala, Val-Arg, Val-Lys, Val-Cit, and Arg-Arg. Cathepsin B similarly recognizes and cleaves the tetra-peptide linkers Gly-Phe-Leu-Gly and Ala-Leu-Ala-Leu after the fourth amino acid residue.

In addition, the tri-peptide linker Ala-Ala-Asn is cleaved by the enzyme legumain after the last amino acid residue. The tetra-peptide linkers Lys-Ala-Gly-Gly, Leu-Arg-Gly-Gly, and Arg-Lys-Arg-Arg are cleaved by the papain-like protease enzyme.

Peptide linkers Arg-Arg-X, Ala-Leu-X, Gly-Leu-Phe-Gly-X, Gly-Phe-Leu-Gly-X, and Ala-Leu-Ala-Leu-X, where X is any amino acid, are cleaved by the enzymes cathepsin B, H, and L. Cathepsin B, H, and L are responsible for lysosomal degradation of proteins.

Peptide linkers Phe-Ala-Ala-Phe($NO_2$)-Phe-Val-Leu-OM4P-X and Bz-Arg-Gly-Phe-Phe-Pro-4mβNA, where X is any amino acid, are cleaved by the enzyme cathepsin D.

Serum plasminogen activator is produced in many tumor cells. Plasminogen is converted to plasmin, thus producing a high-level of plasmin in the tumor cells. This plasmin is degraded rapidly in the plasma and hence tissues remote to the tumor are not exposed to plasmin. Plasmin is responsible for the fibrinolysis and degradation of blood plasma proteins and cleaves the peptide linkers D-Val-Leu-Lys-X, D-Ala-Phe-Lys-X, and D-Ala-Trp-Lys-X, where X is any amino acid.

Tissue plasminogen activator (tPA) and urokinase (uPA) are responsible for activation of plasmin formation and can each cleave the peptide linker Gly-Gly-Gly-Arg-Arg-Arg-Val-X, where X is any amino acid.

Prostate-specific antigen is responsible for liquefaction of semen and cleaves the peptide linker morpholinocarbonyl-His-Ser-Ser-Lys-Leu-Gln-Leu-X, where X is any amino acid.

Matrix metalloproteases (MMP-2 and MM-9) are responsible for degradation of extracellular matrix and collagens and cleave the peptide linkers Ac-Pro-Leu-Gln-Leu-X and Gly-Pro-Leu-Gly-Ile-Ala-Gly-Gln-X, where X is any amino acid.

APIs

In accordance with some embodiments, the API may be a small molecule. For example, small molecule APIs useful in the treatment of cancer include, but are not limited to, methotrexate; doxorubicin; vinca alkaloids; camptothecin analogues; microtubule-disrupting agents such as auristatins (e.g., MMAE and MMAF) and maytansinoids (e.g., DM1 and DM4); and DNA-damaging agents such as DNA topoisomerase I inhibitors (e.g., SN-38 and exatecan), double-strand break agents (e.g., calicheamicin), cross-linkers (e.g., pyrrolobenzodiazepine dimer-PBD), and alkylators (e.g., duocarmycin and indolinobenzodiazepine dimer-IGN). See, e.g., Khongorzul et al. *Mol Cancer Res* 18:3-19 (2020); Salomon et al. *Mol Pharm* 16(12):4817-4825 (2019); and Drago et al. *Nat Rev Clin Oncol* 18, 327-344 (2021), each of which is hereby incorporated by reference herein in its entirety.

In accordance with other embodiments, the API may be small-interfering RNA ("siRNA"). siRNA is a double-stranded RNA molecule that can reduce the expression of a specific gene by causing the degradation of the gene's mRNA transcript(s), which shares partial complementarity with a strand of the double-stranded siRNA molecule. The process of reducing the expression of a gene using siRNA is referred to as RNA interference ("RNAi"). See U.S. Pat. Nos. 7,056,704, 7,078,196, 8,372,968 each of which is hereby incorporated by reference herein its entirety.

Several genes have been implicated in promoting cancer progression and cancer cell proliferation through various mechanisms. These genes, and their mRNA transcripts are listed in Table 1. By reducing the expression of one or more genes from Table 1, cancer progression and cancer cell proliferation may be inhibited. Thus, the transcripts of the genes listed in Table 1 represent key targets for the treatment of cancer using siRNA-mediated RNAi.

In some embodiments, an API useful for the treatment of cancer in a mammal is siRNA, the siRNA being a double-stranded RNA molecule including an antisense RNA strand and a sense RNA strand, wherein: (a) the antisense RNA strand is 19-29 nucleotides in length and is complementary to contiguous nucleotides in a target mammalian mRNA sequence, the mRNA sequence being selected from the group consisting of SEQ ID NO: 8-747 and 771-824, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length.

In some embodiments, an API useful for the treatment of cancer in a mammal is siRNA, the siRNA being a double-stranded RNA molecule including an antisense RNA strand and a sense RNA strand, wherein: (a) the antisense RNA strand is 19-29 nucleotides in length and is complementary to contiguous nucleotides in a target mammalian mRNA sequence, the mRNA sequence being selected from the group consisting of SEQ ID NO: 22-747 and 771-824, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length.

In some embodiments, an API useful for the treatment of cancer in a mammal is siRNA, the siRNA being a double-stranded RNA molecule including an antisense RNA strand and a sense RNA strand, wherein: (a) the antisense RNA strand is 19-29 nucleotides in length and is complementary to contiguous nucleotides in a target mammalian mRNA sequence, the mRNA sequence selected from the group consisting of SEQ ID NO: 22-37, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length.

In some embodiments, an API useful for the treatment of cancer in a mammal is siRNA, the siRNA being a double-stranded RNA molecule including an antisense RNA strand and a sense RNA strand, wherein: (a) the antisense RNA strand is 19-29 nucleotides in length and is complementary to contiguous nucleotides in a target mammalian mRNA sequence, the mRNA sequence selected from the group consisting of SEQ ID NO: 38-39, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length.

In some embodiments, an API useful for the treatment of cancer in a mammal is siRNA, the siRNA being a double-stranded RNA molecule including an antisense RNA strand and a sense RNA strand, wherein: (a) the antisense RNA strand is 19-29 nucleotides in length and is complementary to contiguous nucleotides in a target mammalian mRNA sequence, the mRNA sequence selected from the group consisting of SEQ ID NO: 40-43, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length.

In some embodiments, an API useful for the treatment of cancer in a mammal is siRNA, the siRNA being a double-stranded RNA molecule including an antisense RNA strand and a sense RNA strand, wherein: (a) the antisense RNA strand is 19-29 nucleotides in length and is complementary to contiguous nucleotides in a target mammalian mRNA sequence, the mRNA sequence selected from the group consisting of SEQ ID NO: 44-51, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length.

TABLE 1 siRNA and shRNA Cancer (Cancer Cell) Target Transcripts

| Gene | GenBank Gene ID | GenBank cDNA RefSeq Accession | (mRNA) SEQ ID NO |
|---|---|---|---|
| CD47 | 961 | NM_001777.4 | 8 |
| | | NM_198793.3 | 9 |
| | | NM_001382306.1 | 10 |
| | | XM_005247909.2 | 11 |
| | | XM_017007536.1 | 12 |
| | | XR_241521.2 | 13 |
| | | XR_241522.2 | 14 |
| | | XR_924218.2 | 15 |
| | | XR_924219.2 | 16 |
| | | XR_924220.2 | 17 |
| | | XR_001740374.2 | 18 |
| | | XR_001740375.2 | 19 |
| | | XR_002959610.1 | 20 |
| | | XR_002959611.1 | 21 |

TABLE 1-continued siRNA and shRNA Cancer (Cancer Cell) Target Transcripts

| Gene | GenBank Gene ID | GenBank cDNA RefSeq Accession | (mRNA) SEQ ID NO |
|---|---|---|---|
| KRAS | 3845 | NM_004985.5 | 22 |
| | | NM_033360.4 | 23 |
| | | NM_001369786.1 | 24 |
| | | NM_001369787.1 | 25 |
| | | NM_004985.5 w/G→T substitution at position 34 | 26 |
| | | NM_033360.4 w/G→T substitution at position 34 | 27 |
| | | NM_001369786.1 w/G→T substitution at position 34 | 28 |
| | | NM_001369787.1 w/G→T substitution at position 34 | 29 |
| | | NM_004985.5 w/G→A substitution at position 35 | 30 |
| | | NM_033360.4 w/G→A substitution at position 35 | 31 |
| | | NM_001369786.1 w/G→A substitution at position 35 | 32 |
| | | NM_001369787.1 w/G→A substitution at position 35 | 33 |
| | | NM_004985.5 w/G→T substitution at position 35 | 34 |
| | | NM_033360.4 w/G→T substitution at position 35 | 35 |
| | | NM_001369786.1 w/G→T substitution at position 35 | 36 |
| | | NM_001369787.1 w/G→T substitution at position 35 | 37 |
| c-MYC | 4609 | NM_002467.6 | 38 |
| | | NM_001354870.1 | 39 |
| CD274 | 29126 | NM_014143.4 | 40 |
| | | NM_001267706.2 | 41 |
| | | NM_001314029.2 | 42 |
| | | NR_052005.2 | 43 |
| CD24 | 100133941 | NM_001359084.1 | 44 |
| | | NM_013230.3 | 45 |
| | | NM_001291737.1 | 46 |
| | | NM_001291738.1 | 47 |
| | | NM_001291739.1 | 48 |
| | | NR_117089.1 | 49 |
| | | NR_117090.1 | 50 |
| | | XM_024446293.1 | 51 |
| BIRC5 | 332 | NM_001168.3 | 52 |
| | | NM_001012270.2 | 53 |
| | | NM_001012271.2 | 54 |
| | | XR_243654.5 | 55 |
| | | XR_934452.3 | 56 |
| PKN3 | 29941 | NM_013355.5 | 57 |
| | | NM_001317926.2 | 58 |
| | | XM_005251946.3 | 59 |
| | | XM_006717080.3 | 60 |
| | | XM_017014649.2 | 61 |
| | | XM_017014650.1 | 62 |
| PLK1 | 5347 | NM_005030.6 | 63 |
| FGF1 | 2246 | NM_000800.5 | 64 |
| | | NM_033136.4 | 65 |
| | | NM_033137.4 | 66 |
| | | NM_001144892.3 | 67 |
| | | NM_001144934.2 | 68 |
| | | NM_001144935.2 | 69 |
| | | NM_001257205.1 | 70 |
| | | NM_001257206.2 | 71 |
| | | NM_001257207.2 | 72 |
| | | NM_001257208.2 | 73 |
| | | NM_001257209.1 | 74 |
| | | NM_001257210.2 | 75 |
| | | NM_001257211.2 | 76 |
| | | NM_001257212.2 | 77 |
| | | NM_001354951.2 | 78 |
| | | NM_001354952.2 | 79 |
| | | NM_001354953.2 | 80 |
| | | NM_001354954.2 | 81 |
| | | NM_001354955.2 | 82 |
| | | NM_001354956.2 | 83 |
| | | NM_001354957.2 | 84 |
| | | NM_001354958.2 | 85 |
| | | NM_001354959.2 | 86 |
| | | NM_001354961.2 | 87 |
| | | NM_001354962.2 | 88 |
| | | NM_001354963.2 | 89 |
| | | NM_001354964.2 | 90 |
| FGF2 | 2247 | NM_001361665.2 | 91 |
| | | NM_002006.5 | 92 |
| FGF5 | 2250 | NM_004464.4 | 93 |
| | | NM_033143.2 | 94 |
| | | NM_001291812.2 | 95 |
| EGFR | 1956 | NM_005228.5 | 96 |
| | | NM_201282.2 | 97 |
| | | NM_201283.2 | 98 |
| | | NM_201284.2 | 99 |
| | | NM_001346897.2 | 100 |
| | | NM_001346898.2 | 101 |
| | | NM_001346899.2 | 102 |
| | | NM_001346900.2 | 103 |
| | | NM_001346941.2 | 104 |
| VEGFA | 7422 | NM_003376.6 | 105 |
| | | NM_001025366.3 | 106 |
| | | NM_001025367.3 | 107 |
| | | NM_001025368.3 | 108 |
| | | NM_001025369.3 | 109 |
| | | NM_001025370.3 | 110 |
| | | NM_001033756.3 | 111 |
| | | NM_001171622.2 | 112 |
| | | NM_001171623.2 | 113 |
| | | NM_001171624.2 | 114 |
| | | NM_001171625.2 | 115 |
| | | NM_001171626.2 | 116 |
| | | NM_001171627.2 | 117 |
| | | NM_001171628.2 | 118 |
| | | NM_001171629.2 | 119 |
| | | NM_001171630.2 | 120 |
| | | NM_001204384.2 | 121 |
| | | NM_001204385.2 | 122 |
| | | NM_001287044.2 | 123 |
| | | NM_001317010.1 | 124 |
| VEGFB | 7423 | NM_003377.5 | 125 |
| | | NM_001243733.2 | 126 |
| KDR | 3791 | NM_002253.4 | 127 |
| ERBB2 | 2064 | NM_004448.4 | 128 |
| | | NM_001005862.3 | 129 |
| | | NM_001289936.2 | 130 |
| | | NM_001289937.2 | 131 |
| | | NM_001289938.2 | 132 |
| | | NM_001382782.1 | 133 |
| | | NM_001382783.1 | 134 |
| | | NM_001382784.1 | 135 |
| | | NM_001382785.1 | 136 |
| | | NM_001382786.1 | 137 |
| | | NM_001382787.1 | 138 |
| | | NM_001382788.1 | 139 |
| | | NM_001382789.1 | 140 |
| | | NM_001382790.1 | 141 |
| | | NM_001382791.1 | 142 |
| | | NM_001382792.1 | 143 |
| | | NM_001382793.1 | 144 |
| | | NM_001382794.1 | 145 |
| | | NM_001382795.1 | 146 |
| | | NM_001382796.1 | 147 |
| | | NM_001382797.1 | 148 |
| | | NM_001382798.1 | 149 |
| | | NM_001382799.1 | 150 |
| | | NM_001382800.1 | 151 |
| | | NM_001382801.1 | 152 |
| | | NM_001382802.1 | 153 |
| | | NM_001382803.1 | 154 |
| | | NM_001382804.1 | 155 |
| | | NM_001382805.1 | 156 |
| | | NM_001382806.1 | 157 |

TABLE 1-continued siRNA and shRNA Cancer (Cancer Cell) Target Transcripts

| Gene | GenBank Gene ID | GenBank cDNA RefSeq Accession | (mRNA) SEQ ID NO |
|---|---|---|---|
|  |  | NR_110535.2 | 158 |
|  |  | XM_024450641.1 | 159 |
|  |  | XM_024450642.1 | 160 |
|  |  | XM_024450643.1 | 161 |
| EPHA2 | 1969 | NM_004431.5 | 162 |
|  |  | NM_001329090.2 | 163 |
|  |  | XM_017000537.1 | 164 |
| RRM2 | 6241 | NM_001034.4 | 165 |
|  |  | NM_001165931.1 | 166 |
|  |  | NR_164157.1 | 167 |
| PSMB9 | 5698 | NM_002800.5 | 168 |
| PSMB8 | 5696 | NM_148919.4 | 169 |
|  |  | NM_004159.5 | 170 |
| MCL1 | 4170 | NM_021960.5 | 171 |
|  |  | NM_182763.3 | 172 |
|  |  | NM_001197320.2 | 173 |
| CBLB | 868 | NM_170662.5 | 174 |
|  |  | NM_001321786.1 | 175 |
|  |  | NM_001321788.2 | 176 |
|  |  | NM_001321789.1 | 177 |
|  |  | NM_001321790.2 | 178 |
|  |  | NM_001321791.2 | 179 |
|  |  | NM_001321793.2 | 180 |
|  |  | NM_001321794.2 | 181 |
|  |  | NM_001321795.2 | 182 |
|  |  | NM_001321796.2 | 183 |
|  |  | NM_001321797.2 | 184 |
|  |  | NM_001321798.2 | 185 |
|  |  | NM_001321799.2 | 186 |
|  |  | NM_001321806.2 | 187 |
|  |  | NM_001321807.2 | 188 |
|  |  | NM_001321808.2 | 189 |
|  |  | NM_001321811.2 | 190 |
|  |  | NM_001321813.1 | 191 |
|  |  | NM_001321816.2 | 192 |
|  |  | NM_001321820.2 | 193 |
|  |  | NM_001321822.2 | 194 |
|  |  | NR_135806.2 | 195 |
|  |  | NR_135807.2 | 196 |
|  |  | NR_135808.2 | 197 |
|  |  | NR_135809.2 | 198 |
|  |  | NR_135810.2 | 199 |
|  |  | NR_135811.2 | 200 |
|  |  | NR_135812.1 | 201 |
|  |  | XM_011513257.1 | 202 |
|  |  | XM_011513259.3 | 203 |
|  |  | XM_017007395.1 | 204 |
|  |  | XM_017007397.1 | 205 |
|  |  | XM_017007396.1 | 206 |
|  |  | XM_017007399.1 | 207 |
|  |  | XM_017007398.1 | 208 |
|  |  | XM_017007400.1 | 209 |
|  |  | XR_001740338.1 | 210 |
|  |  | XR_001740339.1 | 211 |
| RHOA | 387 | NM_001664.4 | 212 |
|  |  | NM_001313941.2 | 213 |
|  |  | NM_001313943.2 | 214 |
|  |  | NM_001313944.2 | 215 |
|  |  | NM_001313945.2 | 216 |
|  |  | NM_001313946.2 | 217 |
|  |  | NM_001313947.2 | 218 |
| FLI1 | 2313 | NM_002017.5 | 219 |
|  |  | NM_001167681.3 | 220 |
|  |  | NM_001271010.2 | 221 |
|  |  | NM_001271012.2 | 222 |
|  |  | XM_011542701.2 | 223 |
|  |  | XM_011542702.1 | 224 |
|  |  | XM_017017405.1 | 225 |
|  |  | XM_017017406.1 | 226 |
| EWSR1 | 2130 | NM_005243.4 | 227 |
|  |  | NM_013986.4 | 228 |
|  |  | NM_001163285.2 | 229 |
|  |  | NM_001163286.2 | 230 |
|  |  | NM_001163287.2 | 231 |
|  |  | XM_005261389.4 | 232 |
|  |  | XM_005261390.4 | 233 |
|  |  | XM_011529995.3 | 234 |
|  |  | XM_011529996.3 | 235 |
|  |  | XM_011529997.2 | 236 |
|  |  | XM_011529998.2 | 237 |
|  |  | XM_011529999.2 | 238 |
|  |  | XM_011530000.2 | 239 |
|  |  | XM_011530001.2 | 240 |
|  |  | XM_011530002.3 | 241 |
|  |  | XM_017028644.2 | 242 |
|  |  | XM_017028645.2 | 243 |
|  |  | XM_017028646.2 | 244 |
|  |  | XM_017028647.2 | 245 |
|  |  | XM_017028649.2 | 246 |
|  |  | XM_017028648.2 | 247 |
|  |  | XM_017028650.2 | 248 |
|  |  | XM_017028651.2 | 249 |
|  |  | XM_017028652.2 | 250 |
|  |  | XM_017028653.2 | 251 |
|  |  | XM_017028654.1 | 252 |
|  |  | XM_017028655.1 | 253 |
|  |  | XM_017028656.2 | 254 |
|  |  | XM_017028657.2 | 255 |
|  |  | XM_017028659.1 | 256 |
|  |  | XM_017028658.1 | 257 |
|  |  | XM_017028660.2 | 258 |
|  |  | XM_017028661.2 | 259 |
|  |  | XM_017028662.2 | 260 |
|  |  | XM_017028663.1 | 261 |
|  |  | XM_017028664.2 | 262 |
|  |  | XM_017028665.2 | 263 |
|  |  | XM_017028666.2 | 264 |
|  |  | XM_024452180.1 | 265 |
|  |  | XM_024452181.1 | 266 |
|  |  | XR_002958676.1 | 267 |
| STAT3 | 6774 | NM_139276.3 | 268 |
|  |  | NM_003150.4 | 269 |
|  |  | NM_213662.2 | 270 |
|  |  | NM_001369512.1 | 271 |
|  |  | NM_001369513.1 | 272 |
|  |  | NM_001369514.1 | 273 |
|  |  | NM_001369516.1 | 274 |
|  |  | NM_001369517.1 | 275 |
|  |  | NM_001369518.1 | 276 |
|  |  | NM_001369519.1 | 277 |
|  |  | NM_001369520.1 | 278 |
|  |  | NM_001384984.1 | 279 |
|  |  | NM_001384985.1 | 280 |
|  |  | NM_001384986.1 | 281 |
|  |  | NM_001384987.1 | 282 |
|  |  | NM_001384988.1 | 283 |
|  |  | NM_001384989.1 | 284 |
|  |  | NM_001384990.1 | 285 |
|  |  | NM_001384991.1 | 286 |
|  |  | NM_001384992.1 | 287 |
|  |  | NM_001384993.1 | 288 |
|  |  | XM_017024973.2 | 289 |
|  |  | XM_024450896.1 | 290 |
| TWIST1 | 7291 | NM_000474.4 | 291 |
|  |  | NR_149001.2 | 292 |
| FOLH1 | 2346 | NM_004476.3 | 293 |
|  |  | NM_001014986.3 | 294 |
|  |  | NM_001193471.3 | 295 |
|  |  | NM_001193472.3 | 296 |
|  |  | NM_001193473.3 | 297 |
|  |  | NM_001351236.2 | 298 |
|  |  | XM_011519958.3 | 299 |
|  |  | XM_017017432.1 | 300 |
|  |  | XM_017017433.2 | 301 |
|  |  | XM_017017434.1 | 302 |
|  |  | XM_017017435.2 | 303 |
|  |  | XM_017017444.2 | 304 |
|  |  | XM_017017445.1 | 305 |

TABLE 1-continued siRNA and shRNA Cancer (Cancer Cell) Target Transcripts

| Gene | GenBank Gene ID | GenBank cDNA RefSeq Accession | (mRNA) SEQ ID NO |
|---|---|---|---|
| | | XM_017017446.1 | 306 |
| | | XM_017017447.1 | 307 |
| | | XM_017017448.1 | 308 |
| | | XM_017017449.2 | 309 |
| | | XM_017017450.2 | 310 |
| | | XM_017017451.2 | 311 |
| | | XM_024448411.1 | 312 |
| | | XR_001747818.1 | 313 |
| | | XR_001747819.1 | 314 |
| HIF1A | 3091 | NM_001530.4 | 315 |
| | | NM_181054.3 | 316 |
| | | NM_001243084.2 | 317 |
| SERPINH1 | 871 | NM_001235.5 | 318 |
| | | NM_001207014.3 | 319 |
| | | XM_011545327.1 | 320 |
| | | XM_024448756.1 | 321 |
| PTK2 | 5747 | NM_001387646.1 | 322 |
| | | NM_005607.5 | 323 |
| | | NM_153831.4 | 324 |
| | | NM_001199649.2 | 325 |
| | | NM_001316342.2 | 326 |
| | | NM_001352694.2 | 327 |
| | | NM_001352695.2 | 328 |
| | | NM_001352696.2 | 329 |
| | | NM_001352697.2 | 330 |
| | | NM_001352698.2 | 331 |
| | | NM_001352699.2 | 332 |
| | | NM_001352700.2 | 333 |
| | | NM_001352701.2 | 334 |
| | | NM_001352702.2 | 335 |
| | | NM_001352703.2 | 336 |
| | | NM_001352704.2 | 337 |
| | | NM_001352705.2 | 338 |
| | | NM_001352706.2 | 339 |
| | | NM_001352707.2 | 340 |
| | | NM_001352708.2 | 341 |
| | | NM_001352709.2 | 342 |
| | | NM_001352710.2 | 343 |
| | | NM_001352711.2 | 344 |
| | | NM_001352712.2 | 345 |
| | | NM_001352713.2 | 346 |
| | | NM_001352714.2 | 347 |
| | | NM_001352715.2 | 348 |
| | | NM_001352716.2 | 349 |
| | | NM_001352717.2 | 350 |
| | | NM_001352718.2 | 351 |
| | | NM_001352719.2 | 352 |
| | | NM_001352720.2 | 353 |
| | | NM_001352721.2 | 354 |
| | | NM_001352722.2 | 355 |
| | | NM_001352723.2 | 356 |
| | | NM_001352724.2 | 357 |
| | | NM_001352725.2 | 358 |
| | | NM_001352726.2 | 359 |
| | | NM_001352727.2 | 360 |
| | | NM_001352728.2 | 361 |
| | | NM_001352729.2 | 362 |
| | | NM_001352730.2 | 363 |
| | | NM_001352731.2 | 364 |
| | | NM_001352732.2 | 365 |
| | | NM_001352733.2 | 366 |
| | | NM_001352734.2 | 367 |
| | | NM_001352735.2 | 368 |
| | | NM_001352736.2 | 369 |
| | | NM_001352737.2 | 370 |
| | | NM_001352738.2 | 371 |
| | | NM_001352739.2 | 372 |
| | | NM_001352740.2 | 373 |
| | | NM_001352741.2 | 374 |
| | | NM_001352742.2 | 375 |
| | | NM_001352743.2 | 376 |
| | | NM_001352744.2 | 377 |
| | | NM_001352745.2 | 378 |
| | | NM_001352746.2 | 379 |
| | | NM_001352747.2 | 380 |
| | | NM_001352748.2 | 381 |
| | | NM_001352749.2 | 382 |
| | | NM_001352750.2 | 383 |
| | | NM_001352751.2 | 384 |
| | | NM_001352752.2 | 385 |
| | | NM_001387584.1 | 386 |
| | | NM_001387585.1 | 387 |
| | | NM_001387586.1 | 388 |
| | | NM_001387587.1 | 389 |
| | | NM_001387588.1 | 390 |
| | | NM_001387589.1 | 391 |
| | | NM_001387590.1 | 392 |
| | | NM_001387591.1 | 393 |
| | | NM_001387592.1 | 394 |
| | | NM_001387603.1 | 395 |
| | | NM_001387604.1 | 396 |
| | | NM_001387605.1 | 397 |
| | | NM_001387606.1 | 398 |
| | | NM_001387607.1 | 399 |
| | | NM_001387608.1 | 400 |
| | | NM_001387609.1 | 401 |
| | | NM_001387610.1 | 402 |
| | | NM_001387611.1 | 403 |
| | | NM_001387612.1 | 404 |
| | | NM_001387613.1 | 405 |
| | | NM_001387614.1 | 406 |
| | | NM_001387615.1 | 407 |
| | | NM_001387616.1 | 408 |
| | | NM_001387617.1 | 409 |
| | | NM_001387618.1 | 410 |
| | | NM_001387619.1 | 411 |
| | | NM_001387620.1 | 412 |
| | | NM_001387621.1 | 413 |
| | | NM_001387622.1 | 414 |
| | | NM_001387623.1 | 415 |
| | | NM_001387624.1 | 416 |
| | | NM_001387625.1 | 417 |
| | | NM_001387627.1 | 418 |
| | | NM_001387628.1 | 419 |
| | | NM_001387629.1 | 420 |
| | | NM_001387630.1 | 421 |
| | | NM_001387631.1 | 422 |
| | | NM_001387632.1 | 423 |
| | | NM_001387633.1 | 424 |
| | | NM_001387634.1 | 425 |
| | | NM_001387635.1 | 426 |
| | | NM_001387636.1 | 427 |
| | | NM_001387637.1 | 428 |
| | | NM_001387638.1 | 429 |
| | | NM_001387639.1 | 430 |
| | | NM_001387640.1 | 431 |
| | | NM_001387641.1 | 432 |
| | | NM_001387642.1 | 433 |
| | | NM_001387643.1 | 434 |
| | | NM_001387644.1 | 435 |
| | | NM_001387645.1 | 436 |
| | | NM_001387647.1 | 437 |
| | | NM_001387648.1 | 438 |
| | | NM_001387649.1 | 439 |
| | | NM_001387650.1 | 440 |
| | | NM_001387651.1 | 441 |
| | | NM_001387652.1 | 442 |
| | | NM_001387653.1 | 443 |
| | | NM_001387654.1 | 444 |
| | | NM_001387655.1 | 445 |
| | | NM_001387656.1 | 446 |
| | | NM_001387657.1 | 447 |
| | | NM_001387658.1 | 448 |
| | | NM_001387659.1 | 449 |
| | | NM_001387660.1 | 450 |
| | | NM_001387661.1 | 451 |
| | | NM_001387662.1 | 452 |
| | | NR_148036.2 | 453 |

TABLE 1-continued siRNA and shRNA Cancer (Cancer Cell) Target Transcripts

| Gene | GenBank Gene ID | GenBank cDNA RefSeq Accession | (mRNA) SEQ ID NO |
|---|---|---|---|
| | | NR_148037.2 | 454 |
| | | NR_148038.2 | 455 |
| | | NR_148039.2 | 456 |
| | | NR_170670.1 | 457 |
| | | NR_170671.1 | 458 |
| | | NR_170672.1 | 459 |
| | | NR_170673.1 | 460 |
| | | XM_017013654.2 | 461 |
| | | XM_017013656.2 | 462 |
| | | XM_017013666.1 | 463 |
| | | XM_017013669.2 | 464 |
| | | XM_017013684.2 | 465 |
| | | XM_017013688.2 | 466 |
| | | XM_024447199.1 | 467 |
| | | XM_024447200.1 | 468 |
| | | XM_024447202.1 | 469 |
| | | XM_024447201.1 | 470 |
| | | XM_024447204.1 | 471 |
| | | XM_024447203.1 | 472 |
| | | XM_024447206.1 | 473 |
| | | XM_024447205.1 | 474 |
| | | XM_024447208.1 | 475 |
| | | XM_024447207.1 | 476 |
| | | XM_024447210.1 | 477 |
| | | XM_024447209.1 | 478 |
| | | XM_024447211.1 | 479 |
| CEACAM6 | 4680 | NM_002483.7 | 480 |
| | | XM_011526990.2 | 481 |
| CXCR4 | 7852 | NM_003467.3 | 482 |
| | | NM_001008540.2 | 483 |
| | | NM_001348056.2 | 484 |
| | | NM_001348059.2 | 485 |
| | | NM_001348060.2 | 486 |
| CTNNB1 | 1499 | NM_001904.4 | 487 |
| | | NM_001098209.2 | 488 |
| | | NM_001098210.2 | 489 |
| | | NM_001330729.2 | 490 |
| | | XM_006712983.2 | 491 |
| | | XM_006712985.1 | 492 |
| | | XM_017005738.1 | 493 |
| | | XM_024453356.1 | 494 |
| | | XM_024453357.1 | 495 |
| | | XM_024453358.1 | 496 |
| | | XM_024453359.1 | 497 |
| | | XM_024453360.1 | 498 |
| BCL2 | 596 | NM_000633.3 | 499 |
| | | NM_000657.3 | 500 |
| | | XM_011526135.3 | 501 |
| | | XM_017025917.2 | 502 |
| | | XR_935248.3 | 503 |
| BCL2L1 | 598 | NM_138578.3 | 504 |
| | | NM_001191.4 | 505 |
| | | NM_001317919.2 | 506 |
| | | NM_001317920.2 | 507 |
| | | NM_001317921.2 | 508 |
| | | NM_001322239.2 | 509 |
| | | NM_001322240.2 | 510 |
| | | NM_001322242.2 | 511 |
| | | NR_134257.1 | 512 |
| | | XM_011528964.2 | 513 |
| | | XM_017027993.1 | 514 |
| | | XR_936599.3 | 515 |
| | | XR_001754364.2 | 516 |
| SST | 6750 | NM_001048.4 | 517 |
| RAF1 | 5894 | NM_001354689.3 | 518 |
| | | NM_002880.4 | 519 |
| | | NM_001354690.3 | 520 |
| | | NM_001354691.3 | 521 |
| | | NM_001354692.3 | 522 |
| | | NM_001354693.3 | 523 |
| | | NM_001354694.3 | 524 |
| | | NM_001354695.3 | 525 |
| | | NR_148940.3 | 526 |
| | | NR_148941.3 | 527 |
| | | NR_148942.3 | 528 |
| | | XM_011533974.3 | 529 |
| | | XM_017006966.1 | 530 |
| | | XR_001740227.1 | 531 |
| SKP2 | 6502 | NM_005983.4 | 532 |
| | | NM_032637.4 | 533 |
| | | NM_001243120.2 | 534 |
| | | XM_011514082.3 | 535 |
| | | XM_011514083.3 | 536 |
| | | XM_017009753.1 | 537 |
| | | XR_001742203.2 | 538 |
| PLAUR | 5329 | NM_002659.4 | 539 |
| | | NM_001005376.3 | 540 |
| | | NM_001005377.3 | 541 |
| | | NM_001301037.2 | 542 |
| | | XM_005258990.5 | 543 |
| | | XM_011527027.2 | 544 |
| | | XM_011527028.3 | 545 |
| | | XM_011527029.2 | 546 |
| | | XM_011527030.2 | 547 |
| | | XM_011527031.3 | 548 |
| | | XM_017026872.2 | 549 |
| | | XM_017026873.1 | 550 |
| MDM2 | 4193 | NM_002392.6 | 551 |
| | | NM_001145337.3 | 552 |
| | | NM_001145339.2 | 553 |
| | | NM_001145340.3 | 554 |
| | | NM_001278462.2 | 555 |
| | | NM_001367990.1 | 556 |
| | | XM_006719399.4 | 557 |
| | | XM_006719400.4 | 558 |
| RAD51 | 5888 | NM_002875.5 | 559 |
| | | NM_133487.4 | 560 |
| | | NM_001164269.2 | 561 |
| | | NM_001164270.2 | 562 |
| | | XM_006720626.3 | 563 |
| | | XM_011521857.2 | 564 |
| | | XM_011521858.2 | 565 |
| | | XM_011521859.2 | 566 |
| | | XM_011521860.2 | 567 |
| | | XM_011521861.2 | 568 |
| | | XM_011521862.3 | 569 |
| EZH2 | 2146 | NM_004456.5 | 570 |
| | | NM_152998.3 | 571 |
| | | NM_001203247.2 | 572 |
| | | NM_001203248.2 | 573 |
| | | NM_001203249.2 | 574 |
| | | XM_005249962.4 | 575 |
| | | XM_005249963.4 | 576 |
| | | XM_005249964.4 | 577 |
| | | XM_011515883.2 | 578 |
| | | XM_011515884.2 | 579 |
| | | XM_011515885.2 | 580 |
| | | XM_011515886.2 | 581 |
| | | XM_011515887.3 | 582 |
| | | XM_011515888.2 | 583 |
| | | XM_011515889.2 | 584 |
| | | XM_011515890.2 | 585 |
| | | XM_011515891.3 | 586 |
| | | XM_011515892.2 | 587 |
| | | XM_011515893.2 | 588 |
| | | XM_011515894.2 | 589 |
| | | XM_011515895.2 | 590 |
| | | XM_011515896.2 | 591 |
| | | XM_011515897.2 | 592 |
| | | XM_011515898.2 | 593 |
| | | XM_011515899.3 | 594 |
| | | XM_011515901.3 | 595 |
| | | XM_017011817.2 | 596 |
| | | XM_017011818.1 | 597 |
| | | XM_017011819.1 | 598 |
| | | XM_017011820.2 | 599 |
| | | XM_017011821.1 | 600 |
| | | XM_024446680.1 | 601 |

TABLE 1-continued siRNA and shRNA Cancer (Cancer Cell) Target Transcripts

| Gene | GenBank Gene ID | GenBank cDNA RefSeq Accession | (mRNA) SEQ ID NO |
|---|---|---|---|
| | | XR_001744581.1 | 602 |
| | | XR_002956413.1 | 603 |
| | | XR_002956414.1 | 604 |
| TP53 | 7157 | NM_000546.6 | 605 |
| | | NM_001126112.3 | 606 |
| | | NM_001126113.3 | 607 |
| | | NM_001126114.3 | 608 |
| | | NM_001126115.2 | 609 |
| | | NM_001126116.2 | 610 |
| | | NM_001126117.2 | 611 |
| | | NM_001126118.2 | 612 |
| | | NM_001276695.3 | 613 |
| | | NM_001276696.3 | 614 |
| | | NM_001276697.3 | 615 |
| | | NM_001276698.3 | 616 |
| | | NM_001276699.3 | 617 |
| | | NM_001276760.3 | 618 |
| | | NM_001276761.3 | 619 |
| CCNB1 | 891 | NM_031966.4 | 620 |
| | | NM_001354844.2 | 621 |
| | | NM_001354845.2 | 622 |
| MAD2L1 | 4085 | NM_002358.4 | 623 |
| AKT1 | 207 | NM_001382430.1 | 624 |
| | | NM_005163.2 | 625 |
| | | NM_001014431.2 | 626 |
| | | NM_001014432.2 | 627 |
| | | NM_001382431.1 | 628 |
| | | NM_001382432.1 | 629 |
| | | NM_001382433.1 | 630 |
| | | XR_002957536.1 | 631 |
| AKT2 | 208 | NM_001626.6 | 632 |
| | | NM_001243027.3 | 633 |
| | | NM_001243028.3 | 634 |
| | | NM_001330511.1 | 635 |
| | | XM_011526614.1 | 636 |
| | | XM_011526615.1 | 637 |
| | | XM_011526616.1 | 638 |
| | | XM_011526618.1 | 639 |
| | | XM_011526619.1 | 640 |
| | | XM_011526620.1 | 641 |
| | | XM_011526622.2 | 642 |
| | | XM_017026470.2 | 643 |
| | | XM_024451416.1 | 644 |
| | | XM_024451417.1 | 645 |
| AKT3 | 10000 | NM_005465.7 | 646 |
| | | NM_181690.2 | 647 |
| | | NM_001206729.2 | 648 |
| | | NM_001370074.1 | 649 |
| | | XM_011544014.2 | 650 |
| | | XM_016999985.1 | 651 |
| | | XM_024446000.1 | 652 |
| | | XM_024446892.1 | 653 |
| | | XM_024447938.1 | 654 |
| PECAM1 | 5175 | NM_000442.5 | 655 |
| | | XM_005276880.1 | 656 |
| | | XM_005276881.1 | 657 |
| | | XM_005276882.1 | 658 |
| | | XM_005276883.2 | 659 |
| | | XM_011524889.2 | 660 |
| | | XM_011524890.1 | 661 |
| | | XM_017024738.1 | 662 |
| | | XM_017024739.1 | 663 |
| | | XM_017024740.1 | 664 |
| | | XM_017024741.1 | 665 |
| KLF5 | 688 | NM_001730.5 | 666 |
| | | NM_001286818.2 | 667 |
| PLXDC1 | 57125 | NM_020405.5 | 668 |
| UBE3A | 7337 | NM_130839.5 | 669 |
| | | NM_000462.5 | 670 |
| | | NM_130838.4 | 671 |
| | | NM_001354505.1 | 672 |
| | | NM_001354506.2 | 673 |
| | | NM_001354507.2 | 674 |
| | | NM_001354508.2 | 675 |
| | | NM_001354509.2 | 676 |
| | | NM_001354511.2 | 677 |
| | | NM_001354512.2 | 678 |
| | | NM_001354513.2 | 679 |
| | | NM_001354523.2 | 680 |
| | | NM_001354526.1 | 681 |
| | | NM_001354538.2 | 682 |
| | | NM_001354539.2 | 683 |
| | | NM_001354540.2 | 684 |
| | | NM_001354541.2 | 685 |
| | | NM_001354542.2 | 686 |
| | | NM_001354543.2 | 687 |
| | | NM_001354544.2 | 688 |
| | | NM_001354545.2 | 689 |
| | | NM_001354546.2 | 690 |
| | | NM_001354547.2 | 691 |
| | | NM_001354548.2 | 692 |
| | | NM_001354549.2 | 693 |
| | | NM_001354550.2 | 694 |
| | | NM_001354551.2 | 695 |
| | | NM_001374461.1 | 696 |
| | | NR_148916.2 | 697 |
| | | XM_011521995.3 | 698 |
| | | XM_017022547.2 | 699 |
| | | XM_017022548.2 | 700 |
| | | XM_017022550.2 | 701 |
| | | XM_017022556.2 | 702 |
| | | XM_024450043.1 | 703 |
| RET | 5979 | NM_020975.6 | 704 |
| | | NM_020630.6 | 705 |
| | | NM_001355216.1 | 706 |
| SSX1 | 6756 | NM_005635.4 | 707 |
| | | NM_001278691.2 | 708 |
| SS18 | 6760 | NM_001007559.3 | 709 |
| | | NM_005637.4 | 710 |
| | | NM_001308201.2 | 711 |
| | | XM_006722527.2 | 712 |
| | | XM_011526145.1 | 713 |
| | | XM_011526147.2 | 714 |
| | | XM_011526148.2 | 715 |
| | | XM_011526149.2 | 716 |
| | | XM_011526150.2 | 717 |
| | | XM_011526151.2 | 718 |
| | | XM_011526152.2 | 719 |
| RECQL | 5965 | NM_002907.4 | 720 |
| | | NM_032941.3 | 721 |
| | | XM_005253461.3 | 722 |
| | | XM_005253462.5 | 723 |
| | | XM_005253463.4 | 724 |
| | | XM_005253464.4 | 725 |
| RAN | 5901 | NM_006325.5 | 726 |
| | | NM_001300796.2 | 727 |
| | | NM_001300797.2 | 728 |
| | | XM_017019772.1 | 729 |
| | | XM_017019773.1 | 730 |
| ABCB1 | 5243 | NM_001348946.2 | 731 |
| | | NM_000927.5 | 732 |
| | | NM_001348944.2 | 733 |
| | | NM_001348945.2 | 734 |
| ACTB | 60 | NM_001101.5 | 735 |
| POSTN | 10631 | NM_006475.3 | 736 |
| | | NM_001135934.2 | 737 |
| | | NM_001135935.2 | 738 |
| | | NM_001135936.2 | 739 |
| | | NM_001286665.2 | 740 |
| | | NM_001286666.2 | 741 |
| | | NM_001286667.2 | 742 |
| | | NM_001330517.2 | 743 |
| | | XM_005266232.2 | 744 |
| | | XM_017020355.1 | 745 |
| | | XM_017020356.1 | 746 |
| KIF11 | 3832 | NM_004523.4 | 747 |
| XIAP | 331 | NM_001167.4 | 771 |
| | | NM_001204401.2 | 772 |

TABLE 1-continued siRNA and shRNA Cancer (Cancer Cell) Target Transcripts

| Gene | GenBank Gene ID | GenBank cDNA RefSeq Accession | (mRNA) SEQ ID NO |
|---|---|---|---|
| | | NM_001378590.1 | 773 |
| | | NM_001378591.1 | 774 |
| | | NM_001378592.1 | 775 |
| | | NR_037916.2 | 776 |
| | | NR_165803.1 | 777 |
| TERT | 7015 | NM_198253.3 | 778 |
| | | NM_001193376.3 | 779 |
| | | NR_149162.3 | 780 |
| | | NR_149163.3 | 781 |
| IGF1R | 3480 | NM_000875.5 | 782 |
| | | NM_001291858.2 | 783 |
| | | XM_011521516.2 | 784 |
| | | XM_011521517.2 | 785 |
| | | XM_017022136.1 | 786 |
| | | XM_017022137.1 | 787 |
| | | XM_017022138.1 | 788 |
| | | XM_017022139.1 | 789 |
| | | XM_024449913.1 | 790 |
| MMP9 | 4318 | NM_004994.3 | 791 |
| CCDC6 | 8030 | NM_005436.5 | 792 |
| NCOA4 | 8031 | NM_001145263.2 | 793 |
| | | NM_005437.4 | 794 |
| | | NM_001145260.2 | 795 |
| | | NM_001145261.2 | 796 |
| | | NM_001145262.2 | 797 |
| CD44 | 960 | NM_000610.4 | 798 |
| | | NM_001001389.2 | 799 |
| | | NM_001001390.2 | 800 |
| | | NM_001001391.2 | 801 |
| | | NM_001001392.2 | 802 |
| | | NM_001202555.2 | 803 |
| | | NM_001202556.2 | 804 |
| | | NM_001202557.2 | 805 |
| | | XM_005253231.3 | 806 |
| | | XM_005253232.3 | 807 |
| | | XM_005253235.3 | 808 |
| | | XM_005253238.3 | 809 |
| | | XM_005253239.3 | 810 |
| | | XM_005253240.3 | 811 |
| | | XM_006718388.2 | 812 |
| | | XM_006718390.4 | 813 |
| | | XM_011520482.2 | 814 |
| | | XM_011520483.2 | 815 |
| | | XM_011520484.2 | 816 |
| | | XM_011520485.2 | 817 |
| | | XM_011520486.2 | 818 |
| | | XM_011520487.3 | 819 |
| | | XM_011520488.2 | 820 |
| | | XM_011520489.3 | 821 |
| | | XM_017018583.2 | 822 |
| | | XM_017018584.2 | 823 |
| | | XM_017018585.2 | 824 |

Reducing the expression of genes using siRNA-mediated RNAi is also useful in the treatment of viral infections. For example, reducing the expression of a set of genes that enables an infected cell to evade the host's immune system, or a set of genes that is required for viral replication, hinders proliferation of the virus in the host. Such genes, and their mRNA transcripts, are listed in Table 2. Thus, the transcripts of the genes listed in Table 2 are key targets for the treatment of a viral infection using siRNA-mediated RNAi.

Accordingly, in some embodiments, an API useful for the treatment of viral infections in a mammal is siRNA, the siRNA being a double-stranded RNA molecule including an antisense RNA strand and a sense RNA strand, wherein: (a) the antisense RNA strand is 19-29 nucleotides in length and is complementary to contiguous nucleotides in a target mammalian mRNA sequence, the mRNA sequence being selected from the group consisting of SEQ ID NO: 8-21, 482-486, and 748-765, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length.

In some embodiments, an API useful for the treatment of viral infections in a mammal is siRNA, the siRNA being a double-stranded RNA molecule including an antisense RNA strand and a sense RNA strand, wherein: (a) the antisense RNA strand is 19-29 nucleotides in length and is complementary to contiguous nucleotides in a target mammalian mRNA sequence, the cDNA sequence being selected from the group consisting of SEQ ID NO: 482-486 and 748-765, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length.

TABLE 2 siRNA and shRNA Viral Infection (Virus-Infected Cell) Target Transcripts

| Gene | GenBank Gene ID | GenBank cDNA RefSeq Accession | (cDNA) SEQ ID NO |
|---|---|---|---|
| CD47 | 961 | NM_001777.4 | 8 |
| | | NM_198793.3 | 9 |
| | | NM_001382306.1 | 10 |
| | | XM_005247909.2 | 11 |
| | | XM_017007536.1 | 12 |
| | | XR_241521.2 | 13 |
| | | XR_241522.2 | 14 |
| | | XR_924218.2 | 15 |
| | | XR_924219.2 | 16 |
| | | XR_924220.2 | 17 |
| | | XR_001740374.2 | 18 |
| | | XR_001740375.2 | 19 |
| | | XR_002959610.1 | 20 |
| | | XR_002959611.1 | 21 |
| ACE2 | 59272 | NM_001371415.1 | 748 |
| | | NM_021804.3 | 749 |
| | | NM_001386259.1 | 750 |
| | | NM_001386260.1 | 751 |
| | | NM_001388452.1 | 752 |
| | | NM_001389402.1 | 753 |
| CCR5 | 1234 | NM_001394783.1 | 754 |
| | | NM_000579.4 | 755 |
| | | NM_001100168.2 | 756 |
| CXCR4 | 7852 | NM_003467.3 | 482 |
| | | NM_001008540.2 | 483 |
| | | NM_001348056.2 | 484 |
| | | NM_001348059.2 | 485 |
| | | NM_001348060.2 | 486 |
| TAT | 6898 | NM_000353.3 | 757 |
| PKN2 | 5586 | NM_006256.4 | 758 |
| | | NM_001320707.2 | 759 |
| | | NM_001320708.2 | 760 |
| | | NM_001320709.2 | 761 |
| | | XM_011541772.2 | 762 |
| | | XM_017001782.2 | 763 |
| | | XM_017001783.2 | 764 |
| EPHA1 | 2041 | NM_005232.5 | 765 |

Increased CD47 expression has been observed in fibrotic fibroblast cells, and blocking CD47 reverses fibrosis by increasing phagocytosis of profibrotic fibroblasts and by eliminating suppressive effects on adaptive immunity. In addition to CD47, expression of other the genes listed in Table 3 has been associated with the promotion of fibrosis. Reducing the expression of these genes using siRNA-mediated RNAi is also useful in the treatment of fibrotic diseases. Such genes, and their mRNA transcripts, are listed in Table 3. Thus, the transcripts of the genes listed in Table 3 represent key targets for the treatment of fibrotic diseases using siRNA-mediated RNAi.

In some embodiments, an API useful for the treatment of fibrotic disease in a mammal is siRNA, the siRNA being a double-stranded RNA molecule including an antisense RNA strand and a sense RNA strand, wherein: (a) the antisense RNA strand is 19-29 nucleotides in length and is complementary to contiguous nucleotides in a target mammalian mRNA sequence, the mRNA sequence being selected from the group consisting of SEQ ID NO: 8-21, 40-43, and 766-770, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length.

In some embodiments, an API useful for the treatment of fibrotic disease in a mammal is siRNA, the siRNA being a double-stranded RNA molecule including an antisense RNA strand and a sense RNA strand, wherein: (a) the antisense RNA strand is 19-29 nucleotides in length and is complementary to contiguous nucleotides in a target mammalian mRNA sequence, the mRNA sequence being selected from the group consisting of SEQ ID NO: 40-43, and 766-770, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length.

TABLE 3 siRNA and shRNA Fibrotic Disease (Fibrotic Cell) Target Transcripts

| Gene | GenBank Gene ID | GenBank cDNA RefSeq Accession | (mRNA) SEQ ID NO |
|---|---|---|---|
| CD47 | 961 | NM_001777.4 | 8 |
| | | NM_198793.3 | 9 |
| | | NM_001382306.1 | 10 |
| | | XM_005247909.2 | 11 |
| | | XM_017007536.1 | 12 |
| | | XR_241521.2 | 13 |
| | | XR_241522.2 | 14 |
| | | XR_924218.2 | 15 |
| | | XR_924219.2 | 16 |
| | | XR_924220.2 | 17 |
| | | XR_001740374.2 | 18 |
| | | XR_001740375.2 | 19 |
| | | XR_002959610.1 | 20 |
| | | XR_002959611.1 | 21 |
| CD274 | 29126 | NM_014143.4 | 40 |
| | | NM_001267706.2 | 41 |
| | | NM_001314029.2 | 42 |
| | | NR_052005.2 | 43 |
| JUN | 3725 | NM_002228.4 | 766 |
| CFTR | 1080 | NM_000492.4 | 767 |
| SCNN1A | 6337 | NM_001038.6 | 768 |
| | | NM_001159575.2 | 769 |
| | | NM_001159576.2 | 770 |

In accordance with some embodiments, the API may be a short hairpin RNA ("shRNA"). Short hairpin RNA is a single-stranded RNA molecule, forming a stem loop structure, that can reduce the expression of a specific gene by causing the degradation of the gene's mRNA transcript(s), which shares partial complementarity with a region of the shRNA molecule. As with siRNA, the process of reducing the expression of a gene using shRNA is referred to as RNAi. See generally, Rao et al. *Adv Drug Deliv Rev* 61(9):746-59 (2009), which is hereby incorporated by reference herein its entirety.

Several genes have been implicated in promoting cancer progression and cancer cell proliferation through various mechanisms. These genes, and their mRNA transcripts, are listed in Table 1. By reducing the expression of one or more genes from Table 1, cancer progression and cancer cell proliferation may be inhibited. Thus, the transcripts of the genes listed in Table 1 represent key targets for the treatment of cancer using shRNA-mediated RNAi.

Accordingly, in some embodiments, an API useful for the treatment of cancer in a mammal is shRNA, the shRNA being a single-stranded RNA molecule of 44-71 nucleotides in length, and having, in a 5' to 3' direction: a first region of 19-29 nucleotides at the 5' end of the single-stranded RNA molecule, the first region having a first sequence; a second region of 4-11 nucleotides directly adjacent to the first region, the second region having a second sequence; a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein: (a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 8-747 and 771-824, and (d) the single-stranded RNA molecule is configured to form a stem loop structure, the first region base pairing with the third region to form a stem, the second region forming a loop, and the fourth region forming a 3' overhang.

In some embodiments, an API useful for the treatment of cancer in a mammal is shRNA, the shRNA being a single-stranded RNA molecule of 44-71 nucleotides in length, and having, in a 5' to 3' direction: a first region of 19-29 nucleotides at the 5' end of the single-stranded RNA molecule, the first region having a first sequence; a second region of 4-11 nucleotides directly adjacent to the first region, the second region having a second sequence; a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein: (a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 22-747 and 771-824, and (d) the single-stranded RNA molecule is configured to form a stem loop structure, the first region base pairing with the third region to form a stem, the second region forming a loop, and the fourth region forming a 3' overhang.

In some embodiments, an API useful for the treatment of cancer in a mammal is shRNA, the shRNA being a single-stranded RNA molecule of 44-71 nucleotides in length, and having, in a 5' to 3' direction: a first region of 19-29 nucleotides at the 5' end of the single-stranded RNA molecule, the first region having a first sequence; a second region of 4-11 nucleotides directly adjacent to the first region, the second region having a second sequence; a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein: (a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 22-37, and (d) the single-stranded RNA molecule is configured to form a stem loop structure, the first region base pairing with the third region to form a stem, the second region forming a loop, and the fourth region forming a 3' overhang.

In some embodiments, an API useful for the treatment of cancer in a mammal is shRNA, the shRNA being a single-stranded RNA molecule of 44-71 nucleotides in length, and having, in a 5' to 3' direction: a first region of 19-29 nucleotides at the 5' end of the single-stranded RNA molecule, the first region having a first sequence; a second region of 4-11 nucleotides directly adjacent to the first region, the second region having a second sequence; a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein: (a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 38-39, and (d) the single-stranded RNA molecule is configured to form a stem loop structure, the first region base pairing with the third region to form a stem, the second region forming a loop, and the fourth region forming a 3' overhang.

In some embodiments, an API useful for the treatment of cancer in a mammal is shRNA, the shRNA being a single-stranded RNA molecule of 44-71 nucleotides in length, and having, in a 5' to 3' direction: a first region of 19-29 nucleotides at the 5' end of the single-stranded RNA molecule, the first region having a first sequence; a second region of 4-11 nucleotides directly adjacent to the first region, the second region having a second sequence; a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein: (a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 40-43, and (d) the single-stranded RNA molecule is configured to form a stem loop structure, the first region base pairing with the third region to form a stem, the second region forming a loop, and the fourth region forming a 3' overhang.

In some embodiments, an API useful for the treatment of cancer in a mammal is shRNA, the shRNA being a single-stranded RNA molecule of 44-71 nucleotides in length, and having, in a 5' to 3' direction: a first region of 19-29 nucleotides at the 5' end of the single-stranded RNA molecule, the first region having a first sequence; a second region of 4-11 nucleotides directly adjacent to the first region, the second region having a second sequence; a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein: (a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 44-51, and (d) the single-stranded RNA molecule is configured to form a stem loop structure, the first region base pairing with the third region to form a stem, the second region forming a loop, and the fourth region forming a 3' overhang.

Reducing the expression of genes using shRNA-mediated RNAi is also useful in the treatment of viral infections. For example, reducing the expression of a set of genes that enables an infected cell to evade the host's immune system, or a set of genes that is required for viral replication, hinders proliferation of the virus in the host. Such genes, and their mRNA transcripts, are listed in Table 2. Thus, the transcripts of the genes listed in Table 2 are also key targets for the treatment of a viral infection using shRNA-mediated RNAi.

Accordingly, in some embodiments, an API useful for the treatment of viral infections in a mammal is shRNA, the shRNA being a single-stranded RNA molecule of 44-71 nucleotides in length, and having, in a 5' to 3' direction: a first region of 19-29 nucleotides at the 5' end of the single-stranded RNA molecule, the first region having a first sequence; a second region of 4-11 nucleotides directly adjacent to the first region, the second region having a second sequence; a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein: (a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 8-21, 482-486, and 748-765, and (d) the single-stranded RNA molecule is configured to form a stem loop structure, the first region base pairing with the third region to form a stem, the second region forming a loop, and the fourth region forming a 3' overhang.

In some embodiments, an API useful for the treatment of viral infections in a mammal is shRNA, the shRNA being a single-stranded RNA molecule of 44-71 nucleotides in length, and having, in a 5' to 3' direction: a first region of 19-29 nucleotides at the 5' end of the single-stranded RNA molecule, the first region having a first sequence; a second region of 4-11 nucleotides directly adjacent to the first region, the second region having a second sequence; a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein: (a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 482-486 and 748-765, and (d) the single-stranded RNA molecule is configured to form a stem loop structure, the first region base pairing with the third region to form a stem, the second region forming a loop, and the fourth region forming a 3' overhang.

As noted above, increased CD47 expression has been observed in fibrotic fibroblast cells, and blocking CD47 reverses fibrosis by increasing phagocytosis of profibrotic fibroblasts and by eliminating suppressive effects on adaptive immunity. In addition to CD47, expression of the genes listed in Table 3 has been associated with the promotion of fibrosis. Reducing the expression of these genes using shRNA-mediated RNAi is also useful in the treatment of fibrotic diseases. Such genes, and their mRNA transcripts, are listed in Table 3. Thus, the transcripts of the genes listed in Table 3 also represent key targets for the treatment of fibrotic diseases using shRNA-mediated RNAi.

Accordingly, in some embodiments, an API useful for the treatment of fibrotic disease in a mammal is shRNA, the shRNA being a single-stranded RNA molecule of 44-71 nucleotides in length, and having, in a 5' to 3' direction: a first region of 19-29 nucleotides at the 5' end of the single-stranded RNA molecule, the first region having a first sequence; a second region of 4-11 nucleotides directly adjacent to the first region, the second region having a second sequence; a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein: (a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 8-21, 40-43, and 766-770, and (d) the single-stranded RNA molecule is configured to form a stem loop structure, the first region base pairing with the third region to form a stem, the second region forming a loop, and the fourth region forming a 3' overhang.

In some embodiments, an API useful for the treatment of fibrotic disease in a mammal is shRNA, the shRNA being a single-stranded RNA molecule of 44-71 nucleotides in length, and having, in a 5' to 3' direction: a first region of 19-29 nucleotides at the 5' end of the single-stranded RNA molecule, the first region having a first sequence; a second region of 4-11 nucleotides directly adjacent to the first region, the second region having a second sequence; a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein: (a) the first region has the same number of nucleotides as the third region, (b) the third sequence is the reverse-complement of the first sequence, (c) the third region is complementary to contiguous nucleotides in a mammalian mRNA sequence, the mRNA sequence being selected from the group consisting of SEQ ID NO: 40-43 and 766-770, and (d) the single-stranded RNA molecule is configured to form a stem loop structure, the first region base pairing with the third region to form a stem, the second region forming a loop, and the fourth region forming a 3' overhang.

MicroRNA ("miRNA")-based therapeutics include miRNAs (and miRNA mimics) and inhibitors of miRNAs ("anti-miRs").

miRNAs are transcribed as single stranded RNA precursors having a stem-loop structure and are subsequently processed in the cytosol by the Dicer enzyme, producing a mature double-stranded product ("mature miRNA product"). These mature miRNA products are thought to have regulatory roles, including RNA silencing and post-transcriptional regulation of gene expression, through their complementarity to mRNA.

Expression of the miRNAs shown in Table 4 is known to be downregulated in various cancers and replenishment of a downregulated miRNA offers a promising therapy for the treatment of cancer.

Accordingly, in some embodiments, an API useful for the treatment of cancer in a mammal is an miRNA selected from the group consisting of SEQ ID NO: 825-844, 849-851, 853, 855, 857, 864, 865, and 867-883.

TABLE 4

Therapeutic Cancer (Cancer Cell) miRNA APIs

| miRNA | miRNA Gene | GenBank cDNA RefSeq Accession | (miRNA) SEQ ID NO |
|---|---|---|---|
| miR-34a | MIR34A | NR_029610.1 | 825 |
| miR-34b | MIR34B | NR_029839.1 | 826 |
| miR-34c | MIR34C | NR_029840.1 | 827 |
| miR-200a | MIR200A | NR_029834.1 | 828 |
| miR-200b | MIR200B | NR_029639.1 | 829 |
| miR-200c | MIR200C | NR_029779.1 | 830 |
| miR-26a-1 | MIR26A1 | NR_029499.1 | 831 |
| miR-506 | MIR506 | NR_030233.1 | 832 |
| miR-520a | MIR520A | NR_030189.1 | 833 |
| miR-520b | MIR520B | NR_030195.1 | 834 |
| miR-520c | MIR520C | NR_030198.1 | 835 |
| miR-520d | MIR520D | NR_030204.1 | 836 |
| miR-520e | MIR520E | NR_030183.1 | 837 |
| miR-520f | MIR520F | NR_030186.1 | 838 |
| miR-520g | MIR520G | NR_030206.1 | 839 |
| miR-520h | MIR520H | NR_030215.1 | 840 |
| miR-15a | MIR15A | NR_029485.1 | 841 |
| miR-15b | MIR15B | NR_029663.1 | 842 |
| miR-16-1 | MIR16-1 | NR_029486.1 | 843 |
| miR-16-2 | MIR16-2 | NR_029525.1 | 844 |
| miR-Let-7a-1 | MIRLET7A1 (LET7A1) | NR_029476.1 | 849 |
| miR-Let-7f-1 | MIRLET7F1 (LET7F1) | NR_029483.1 | 850 |
| miR-Let-7d | MIRLET7D (LET7D) | NR_029481.1 | 851 |
| miR-31 | MIR31 | NR_029505.1 | 853 |
| miR-98 | MIR98 | NR_029513.1 | 855 |
| miR-205 | MIR205 | NR_029622.1 | 857 |
| miR-324 | MIR324 (MIR324-5P) | NR_029896.1 | 864 |
| miR-195 | MIR195 | NR_029712.1 | 865 |
| miR-26a-2 | MIR26A2 | NR_029847.1 | 867 |
| miR-101-1 | MIR101-1 | NR_029516.1 | 868 |
| miR-101-2 | MIR101-2 | NR_029836.1 | 869 |
| miR-145 | MIR145 | NR_029686.1 | 870 |
| miR-331 | MIR331 | NR_029895.1 | 871 |
| miR-29b-1 | MIR29B1 | NR_029517.1 | 872 |
| miR-29b-2 | MIR29B2 | NR_029518.1 | 873 |
| miR-7-1 | MIR7-1 | NR_029605.1 | 874 |
| miR-7-2 | MIR7-2 | NR_029606.1 | 875 |
| miR-7-3 | MIR7-3 | NR_029607.1 | 876 |
| miR-33a | MIR33A | NR_029507.1 | 877 |
| miR-21 | MIR21 | NR_029493.1 | 878 |
| miR-203a | MIR203A | NR_029620.1 | 879 |
| miR-203b | MIR203B | NR_039859.1 | 880 |
| miR-4711 | MIR4711 | NR_039861.1 | 881 |
| miR-4689 | MIR4689 | NR_039838.1 | 882 |
| miR-122 | MIR122 | NR_029667.1 | 883 |

In contrast to miRNA, an antimiR (also known as an "antagomir") is a single stranded antisense oligonucleotide ("ASO") having a sequence that is complementary to the sequence of a region of a target mature miRNA product. Mature miRNA products are short single-stranded RNA molecules that are produced after an miRNA molecule is processed in the cytosol. Typically, two mature miRNA products are produced from an miRNA molecule: a 5p RNA molecule (so named because it is processed from the 5' arm of the duplex formed as the stem of an miRNA), and a 3p RNA molecule (so named because it is processed from the 3' arm of the duplex formed as the stem of an miRNA). The 5p and 3p molecules may base pair with each other to form a duplex, and each molecule may be functional—and indeed, may serve a separate function-within a cell through their complementarity to mRNA. In some instances, an miRNA molecule is processed such that only a single functional mature miRNA product is produced.

By binding to their target mature miRNA product through complementary base pairing, antimiRs are able to block the mature miRNA product from binding to its target, thereby inhibiting the functioning of the mature miRNA product. Using antimiR to inhibit mature miRNA products is referred to as miRNA knockdown. See generally Quemener et al. *Wiley Interdiscip Rev RNA* (5):e1594 (2020), which is hereby incorporated by reference herein in its entirety.

antimiRs are 12-25 nucleotides in length and are complementary to consecutive nucleotides of a target mature miRNA product. Different types of nucleic acids may be used to generate an antimiR. Preferably, the antimiR comprises RNA, as RNA/RNA hybrids are very stable. In addition, antimiR may comprise DNA, or comprise both RNA and DNA nucleotides (referred to herein as a "chimera"). An antimiR should bind with high affinity, through complementary base pairing, to the "seed region" of a mature miRNA product, which spans nucleotides 2-8 from the 5'-end of the mature miRNA product (Lennox et al. *Gene Therapy* 18: 1111-20 (2011), which is hereby incorporated by reference herein in its entirety.)

Over the years, significant improvements in binding affinity, stability, and target modulation effects of antimiRs have been achieved through chemical modifications to the oligonucleotide backbone. An antimiR may therefore be an RNA derivative or a DNA derivative. In some embodiments, the antimiR comprises a modification providing the antimiR with an additional property, for instance resistance to endonucleases and RNaseH, stability (for instance in a bodily fluid), and reduced toxicity. In some embodiments, the modification is a 2'-O-methyl-phosphorothioate oligoribonucleotide modification, a 2'-O-methoxyethyl oligoribonucleotide modification, and combinations thereof. In some embodiments, the antimiR comprises a peptide nucleic acid, locked nucleic acid, or a morpholino phosphorodiamidate. See generally Wahlestedt et al. PNAS 97, 5633-5638 (2000); Elayadi et al. *Curr Opin Investig Drugs* 2, 558-61 (2001); Larsen et al. *Biochim Biophys Acta* 1489, 159-166 (1999); Braasch et al. *Biochemistry* 41, 4503-4510 (2002); Summerton et al. *Antisense Nucleic Acid Drug Dev* 7, 187-195 (1997), each of which is hereby incorporated by reference herein in its entirety.

Expression of the miRNAs shown in Table 5 is known to be upregulated in various cancers and their mature miRNA products, as shown in Table 6, are preferred targets for miRNA knockdown for the treatment of cancer.

Accordingly, in some embodiments, an API useful for the treatment of cancer in a mammal is an antimiR, the antimiR being a single-stranded nucleic acid molecule of 12-25 nucleotides in length, the antimiR having a sequence of 12-25 contiguous nucleotides that is complementary to contiguous nucleotides in a target mature miRNA product sequence, the mature miRNA product sequence being selected from the group consisting of SEQ ID NO: 884-908, wherein the contiguous nucleotides in the mature miRNA product sequence includes, in a 5' to 3' direction, nucleotides 2 to 8 of the mature miRNA product sequence.

TABLE 5

Upregulated miRNA Expression in Cancer

| miRNA Gene | GenBank cDNA RefSeq Accession | miRNA | (miRNA) SEQ ID NO |
|---|---|---|---|
| MIR10B | NR_029609.1 | miR-10b | 845 |
| MIR221 | NR_029635.1 | miR-221 | 846 |
| MIR155 | NR_030784.1 | miR-155 | 847 |
| MIR630 | NR_030359.1 | miR-630 | 848 |
| MIR27A | NR_029501.1 | miR-27a | 852 |
| MIR96 | NR_029512.1 | miR-96 | 854 |
| MIR182 | NR_029614.1 | miR-182 | 856 |
| MIR93 | NR_029510.1 | miR-93 | 858 |
| MIR375 | NR_029867.1 | miR-375 | 859 |
| MIR25 | NR_029498.1 | miR-25 | 860 |
| MIR106B | NR_029831.1 | miR-106b | 861 |
| MIR512-1 | NR_030180.1 | miR-512-1 | 862 |
| MIR512-2 | NR_030181.1 | miR-512-2 | 863 |
| MIR18A | NR_029488.1 | miR-18a | 866 |

TABLE 6 antimiR Cancer (Cancer Cell) Target Mature miRNA Products

| miRNA | Mature miRNA Product | (Mature miRNA Product) SEQ ID NO |
|---|---|---|
| miR-10b | hsa-miR-10b-5p | 884 |
|  | hsa-miR-10b-3p | 885 |
| miR-221 | hsa-miR-221-5p | 886 |
|  | hsa-miR-221-3p | 887 |
| miR-155 | hsa-miR-155-5p | 888 |
|  | hsa-miR-155-3p | 889 |
| miR-630 | hsa-miR-630 | 890 |
| miR-27a | hsa-miR-27a-5p | 891 |
|  | hsa-miR-27a-3p | 892 |
| miR-96 | hsa-miR-96-5p | 893 |
|  | hsa-miR-96-3p | 894 |
| miR-182 | hsa-miR-182-5p | 895 |
|  | hsa-miR-182-3p | 896 |
| miR-93 | hsa-miR-93-5p | 897 |
|  | hsa-miR-93-3p | 898 |
| miR-375 | hsa-miR-375-5p | 899 |
|  | hsa-miR-375-3p | 900 |
| miR-25 | hsa-miR-25-5p | 901 |
|  | hsa-miR-25-3p | 902 |
| miR-106b | hsa-miR-106b-5p | 903 |
|  | hsa-miR-106b-3p | 904 |
| miR-512-1 | hsa-miR-512-5p | 905 |
|  | hsa-miR-512-5p | 906 |
| miR-512-2 | hsa-miR-512-5p | 905 |
|  | hsa-miR-512-5p | 906 |
| miR-18a | hsa-miR-18a-5p | 907 |
|  | hsa-miR-18a-3p | 908 |

In other embodiments, an API useful for the treatment of cancer in a mammal is a protein having anti-cancer properties. Anti-cancer properties include inhibiting the proliferation of a cancer cell, inhibiting the proliferation of a tumor, causing the death of a cancer cell, reducing the size of a tumor, or causing the elimination of a tumor. The proteins listed in Table 7 possess anti-cancer properties. Accordingly, a protein having an amino acid sequence selected from the group consisting of SEQ ID NO: 909-929 and homologs thereof is a suitable APIs for use in accordance with embodiments of the invention. In other embodiments, a protein consisting of an amino acid sequence selected from the group consisting of SEQ ID NO: 909-929 and homologs thereof is a suitable APIs for use in accordance with embodiments of the invention.

In some embodiments, an API suitable for the treatment of cancer in a mammal is an mRNA encoding an amino acid sequence selected from the group consisting of SEQ ID NO: 909-929 and homologs thereof, the mRNA being configured to be translated in a target cell of the mammal to produce a protein comprising the amino acid sequence. In other embodiments, an API suitable for the treatment of cancer in a mammal is an mRNA encoding an amino acid sequence selected from the group consisting of SEQ ID NO: 909-929 and homologs thereof, the mRNA being configured to be translated in a target cell of the mammal to produce a protein consisting of the amino acid sequence. The mRNA may be codon-optimized for translation in the target cell of the mammal.

TABLE 7

Therapeutic Cancer (Cancer Cell) Protein APIs

| Protein | SEQ ID NO |
|---|---|
| Cyclin-dependent kinase 9 (CDK9) | 909 |
| Histidine-rich glycoprotein (HRG) | 910 |
| Interferon alpha-2 (IFNA2) | 911 |
| Interferon beta (IFNB1) | 912 |
| Interferon gamma (IFNG) | 913 |
| Interferon lambda-2 (IFNL2) | 914 |
| Interferon lambda-3 (IFNL3) | 915 |
| Interleukin-27 subunit alpha (IL27) | 916 |
| Interleukin-27 subunit beta (EBI3) | 917 |
| Guanylate kinase (GUK1) | 918 |
| LanC-like protein 2 (LANCL2) | 919 |
| GATOR complex protein NPRL2 (NPRL2) | 920 |
| Solute carrier family 22 member 2 (SLC22A2) | 921 |
| Equilibrative nucleoside transporter 1 (SLC29A1) | 922 |
| Beclin-1 (BECN1) | 923 |
| FK506-binding protein-like (FKBPL) | 924 |
| Ribonuclease pancreatic (RNASE1) | 925 |
| Probable global transcription activator SNF2L2 (SMARCA2) | 926 |
| Metalloproteinase inhibitor 3 (TIMP3) | 927 |
| Tumor necrosis factor ligand superfamily member 10 (TNFSF10) | 928 |
| Collagen alpha-1(XVIII) chain (COL18A1) | 929 |

Example 1: VSIRPα-siRNA Conjugate Binds Red Blood Cells

FAM-tagged siRNA (FIG. 1A) (SEQ TD NO:965 (sense strand) and SEQ TD NO:966 (antisense strand)) was mixed with vSIRPα at a 1:1 molar ratio (50 pmol of vSIRPα and 50 pmol siRNA). The siRNA was modified at its 3' end with maleimide. The vSIRPα was designed with cysteine near its C-terminus. Thiol from the cysteine and maleimide were reacted at a neutral pH via click chemistry. The reaction was held overnight in 4° C. shaker, resulting in the vSIRPα-siRNA conjugate shown in FIG. 1A.

The vSIRPα-siRNA conjugate was isolated using a NAP-5 column using the manufacturer's protocol.

To assess the ability of the vSIRPα-siRNA conjugate to bind red blood cells ("RBC"), the vSIRPα-siRNA conjugate was mixed with mouse RBC, as depicted in FIG. 1B. For this experiment, 6×10⁶ red blood cells, in a volume of 2 µl phosphate-buffered saline ("PBS"), were mixed with 2.5 µl of PBS containing the vSIRPα-siRNA conjugate (totaling 50 pmol of the vSIRPα-siRNA conjugate) and 5.5 µl of PBS.

A negative control was made by mixing 6×10⁶ red blood cells, in a volume of 2 µl PBS, with 8 µl of PBS. Each mixture was then incubated at room temperature (20-25° C.) for 2 hours (FIG. 1B).

After the incubation, 5 µl of each mixture was diluted 20-fold with PBS, for a total volume of 100 µl for each mixture, and each dilution was placed in a glass-bottom dish and fluorescently imaged at 494-567 nm with a microscope (488 nm excitation wavelength).

As can be seen in FIG. 1C, the negative control shows no fluorescence, whereas the mixture containing the vSIRPα-siRNA conjugate shows a strong fluorescence signal associated with the red blood cells, indicating that the vSIRPα-siRNA conjugate binds RBC.

Example 2: vSIRPα-siRNA Conjugate is Transferred from RBC to Cancer Cells as Demonstrated by Flow Cytometry 500 pmol of the vSIRPα-siRNA conjugate from Example 1 was incubated with 5×10³ mouse RBC in Dulbecco's phosphate-buffered saline ("DPBS") at a total volume of 20 µl for 30 min at room temperature (20-25° C.).

After 30 min, the mixture was washed with DPBS by centrifugation at 500×g for 10 minutes and the supernatant was removed. The RBC bound with the vSIRPα-siRNA conjugate were then resuspended to 20 µl PBS.

Two cell lines were used, CT26.CL25 (ATCC CRL-2639) and CaCO2 (ATCC HTB-37). CT26.CL25 is a mouse colon carcinoma cell line. CaCO2 is a human colorectal adenocarcinoma cell line that is deficient in expressing CD47, and was thus used as a negative control (Liu et al. *J Biol Chem* 276(43):40156-66 (2001), which is hereby incorporated by reference herein in its entirety).

Each cell line, grown independently in a cell culture dish, was detached from the dish with trypsin-EDTA. The cells from each dish were then washed with DPBS, counted, and diluted to 10⁵ cells/100 µl PBS. 4 µl of the FAM-vSIRPα-siRNA/RBC resuspension (totaling 10³ RBC and 100 pmol of the vSIRPα-siRNA) was mixed, independently, with each 100 µl dilution of CT26.CL25 cells and CaCO2 cells. Each mixture was incubated for 30 minutes at room temperature (20-25° C.).

After 30 minutes, each mixture was centrifuged, and the supernatants were removed. The cell pellets were resuspended with 200 µl of flow cytometry buffer for flow cytometer analysis.

Figure 2B:
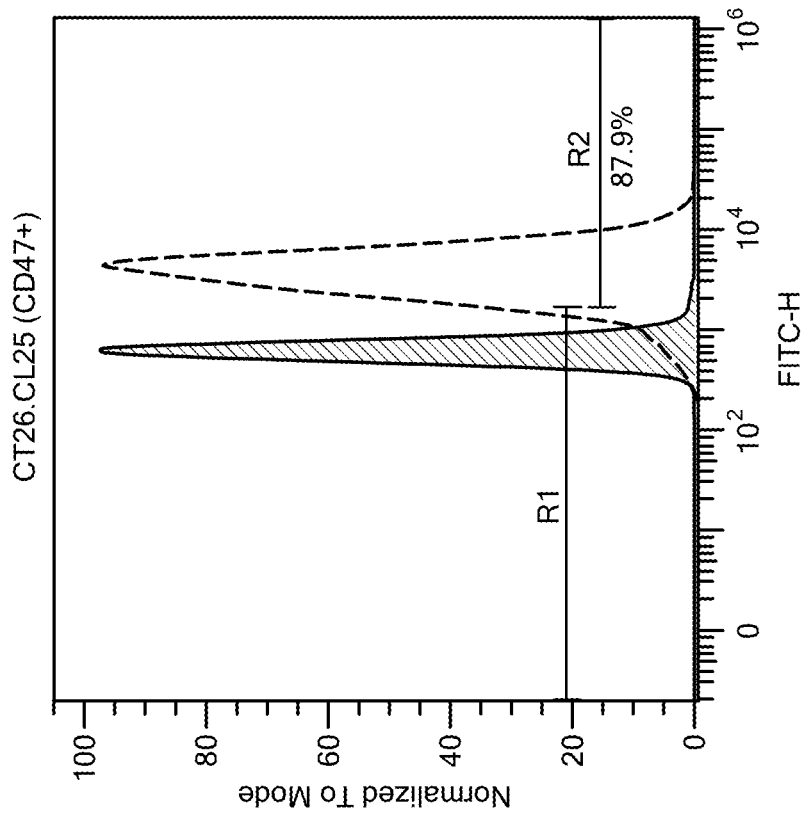
FIG. 2B shows flow cytometry results of CT26.CL25 cells before and after being incubated with red blood cells bound with FAM-tagged vSIRPα-siRNA.
Figure 2A:
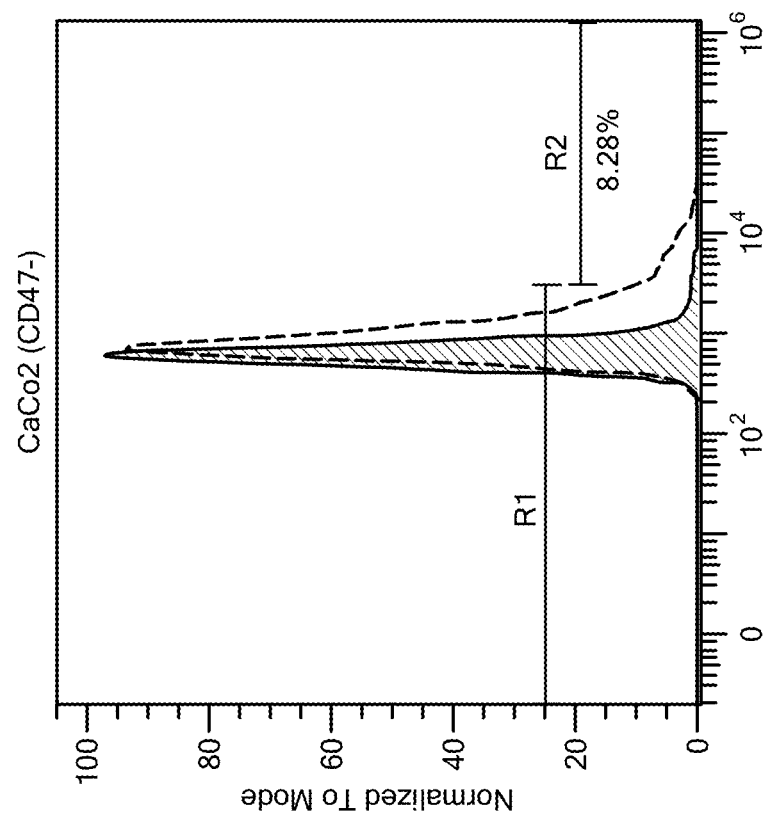
FIG. 2A shows flow cytometry results of CaCO2 cells before and after being incubated with red blood cells bound with FAM-tagged vSIRPα-siRNA, in accordance with embodiments of the invention.

FIGS. 2A and 2B show flow cytometry results for CaCO2 cells and CT26.CL25 cells, respectively. Flow cytometry was conducted using a 488 nm laser for excitation of the FAM tag, and detected at 525-565 nm wavelength. After the incubation with RBCs bound with FAM-tagged vSIRPα-siRNA, each cancer cell line showed different levels of a shift in florescence. These results show a significant fluorescence shift for CT26.CL25 after incubation with RBC and little shift for CaCO2 after incubation with RBC, indicating that the degree of fluorescence shift is dependent on the level of CD47 on the cancer cells. These results strongly suggest that FAM-tagged vSIRPα-siRNA has been transferred from RBC to CD47 present on the surface of the CT26.CL25 cells.

Example 3: Anti-CD47 Antibody is Transferred from RBC to Cancer Cells as Demonstrated by Flow Cytometry First, 0.1 µg of Alexa Fluor® 647 anti-mouse CD47 monoclonal antibody (Biolegend, #127510) was incubated with 4×10³ mouse RBC in a total volume of 100 μl DPBS for 30 minutes at room temperature. After incubation, the RBC-antibody mixture was centrifuged at 500 g for 5 minutes. The supernatant was then decanted and the cells resuspended in 20 μl DPBS.

We then mixed 2×10⁵ CT26.CL25 cells (in 100 μl DPBS) with 10 μl of the resuspended RBC-antibody mixture, for a total volume of 110 μl (mixture #1). Similarly, 2×10⁵ CaCO2 cells (in 100 μl DPBS) were mixed with 10 μl of the resuspended RBC-antibody mixture, for a total volume of 110 μl (mixture #2).

Mixture #1 and mixture #2 were incubated for 30 minutes at room temperature. After incubation, 1 ml of DPBS was added to each mixture, followed by centrifugation at 500 g for 5 minutes. For each mixture, after centrifugation, the supernatant was decanted, and the remaining cells were resuspended in 100 μl DPBS and subject to flow cytometry (Beckman, laser 488 nm, detected 650-670 nm).

FIGS. 3A and 3B show these flow cytometry results for CaCO2 cells and CT26.CL25 cells, respectively. Although not as pronounced as the fluorescence shift observed in Example 2, a greater fluorescence shift was observed for CT26.CL25 cells after incubation with RBC compared to the fluorescence shift for CaCO2 cells after incubation with RBC. This, again, indicates that the degree of fluorescence shift is dependent on the level of CD47 on the cancer cells. These results suggest that the Alexa Fluor® 647 anti-mouse CD47 monoclonal antibody was transferred from RBC to CD47 present on the surface of the CT26.CL25 cells.

Example 4: vSIRPα-siRNA Conjugate is Transferred from RBC to Cancer Cells as Demonstrated by Flow Cytometry The vSIRPα-siRNA-FAM conjugate of Example 1 was further tested for its ability to be transferred from RBC to CD47 present on the surface of CT26.CL25 cells. Experiments were carried out as in Example 2, except that 100 pmol of the conjugate, rather than 500 pmol, was incubated with the RBC.

Figure 4:
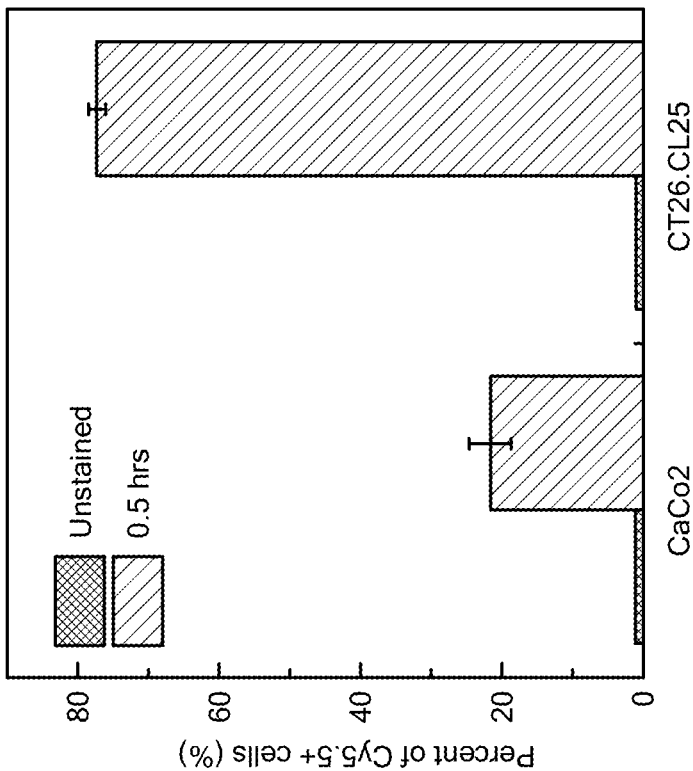
FIG. 4 shows flow cytometry results of CaCO2 cells and CT26.CL25 cells before ("unstained") and after being incubated with red blood cells bound with FAM-tagged vSIRPα-siRNA, in accordance with embodiments of the invention.

As shown in the flow cytometry results of FIG. 4, a significantly greater percentage of CT26.CL25 cells demonstrate FAM fluorescence compared to CaCO2 cells, again, strongly suggesting that FAM-tagged vSIRPα-siRNA has been transferred from RBC to CD47 present on the surface of the CT26.CL25 cells.

Example 5: Cy5.5-labeled vSIRPα is Transferred from RBC to Cancer Cells as Demonstrated by Flow Cytometry vSIRPα labeled with Cy5.5 was tested for its ability to be transferred from RBC to CD47 present on the surface of CT26.CL25 cells. Experiments were carried out as in Example 2, except that 200 pmol of the labeled vSIRPα, rather than 500 pmol of conjugate, was incubated with the RBC.

Figure 5:
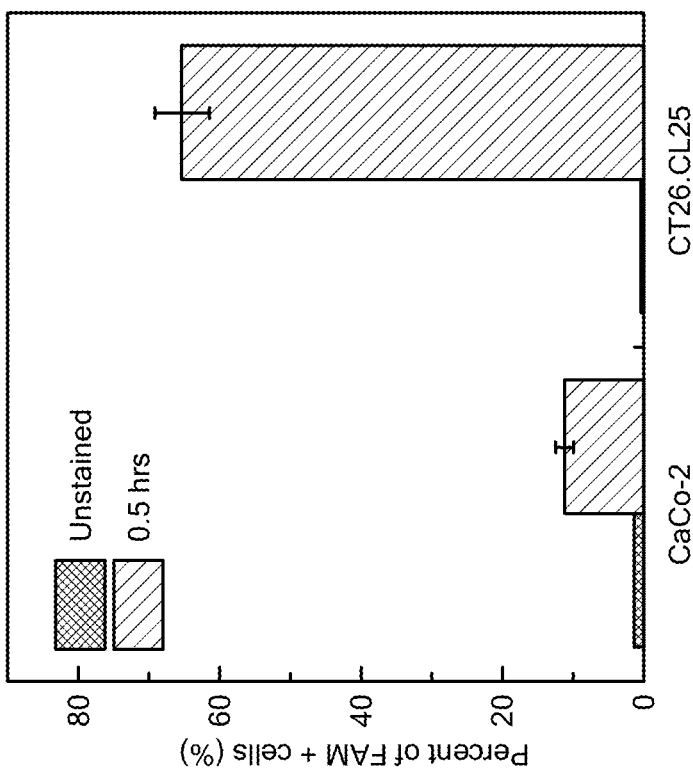
FIG. 5 shows flow cytometry results of CaCO2 cells and CT26.CL25 cells before ("unstained") and after being incubated with red blood cells bound with Cy5.5-labeled vSIRPα, in accordance with embodiments of the invention.

As shown in the flow cytometry results of FIG. 5, a significantly greater percentage of CT26.CL25 cells demonstrate Cy5.5 fluorescence compared to CaCO2 cells, strongly suggesting that vSIRPα labeled with Cy5.5 has been transferred from RBC to CD47 present on the surface of the CT26.CL25 cells.

Example 6: Anti-CD47 Antibody is Transferred from RBC to Cancer Cells as Demonstrated by Flow Cytometry An anti-mouse CD47 monoclonal antibody (Biolegend, #127510) labeled with Alexa Flour® 647 was tested for its ability to be transferred from RBC to CD47 present on the surface of CT26.CL25 cells. Experiments were carried out as in Example 3, except that 1 μg of the labeled antibody, rather than 0.1 μg, was incubated with the RBC.

Figure 6:
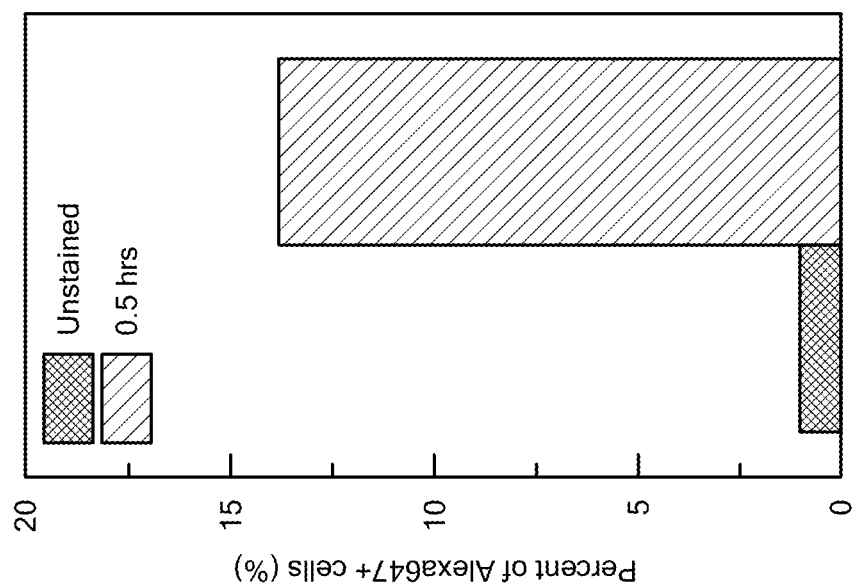
FIG. 6 shows flow cytometry results of CT26.CL25 cells before ("unstained") and after being incubated with red blood cells bound with an Alexa Fluor® 647 anti-mouse CD47 monoclonal antibody, in accordance with embodiments of the invention.

As shown in the flow cytometry results of FIG. 6, a significantly greater percentage of CT26.CL25 cells demonstrate Alexa Fluor® 647 fluorescence compared to unstained cells, strongly suggesting that the anti-CD47 antibody conjugated to Alexa Flour® 647 has been transferred from RBC to CD47 present on the surface of the CT26.CL25 cells. This experiment also demonstrates that monoclonal antibodies against CD47 are capable of being transferred from RBC to CD47 present on the surface of cancer cells.

Example 7: An Antibody-miR21 Conjugate is Transferred from RBC to Cancer Cells as Demonstrated by Flow Cytometry An anti-CD47 monoclonal antibody (Bioxcell, #BE0270) conjugated to Cy5 labeled miR21 (SEQ ID NO:878) was tested for its ability to be transferred from RBC to CD47 present on the surface of CT26.CL25 cells. Experiments were carried out as in Example 3, except that 15.8 μg of the antibody conjugate, rather than 0.1 μg, was incubated with the RBC.

Figure 7:
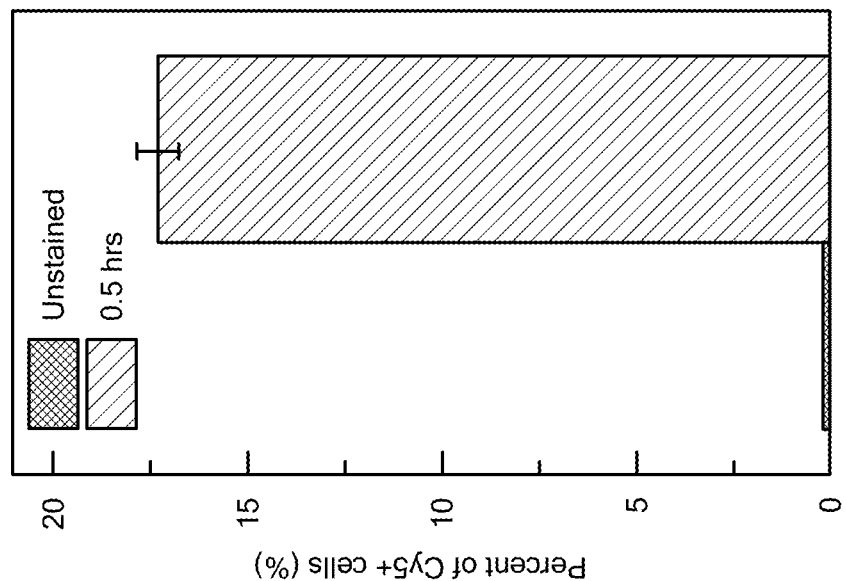
FIG. 7 shows flow cytometry results of CT26.CL25 cells before ("unstained") and after being incubated with red blood cells bound with a CD47mAb-miR21-Cy5 conjugate, in accordance with embodiments of the invention.

As shown in the flow cytometry results of FIG. 7, a greater percentage of CT26.CL25 cells demonstrate Cy5 fluorescence compared to unstained cells, strongly suggesting that the CD47mAb-miR21-Cy5 conjugate has been transferred from RBC to CD47 present on the surface of the CT26.CL25 cells.

Example 8: Thrombospondin-1 is Transferred from RBC to Cancer Cells as Demonstrated by Flow Cytometry Thrombospondin-1 (TSP-1) is a matricellular protein that inhibits angiogenesis and endothelial cell proliferation. TSP-1 binds CD47. The TSP-1 signaling pathway has been found to be involved in various conditions, such as renal disease, cardiovascular disease, inflammation, and cancer. The underlying mechanisms and pathways for TSP-1 are yet to be fully elucidated. However, the function of TSP-1 on several key receptors CD36/VEGF and CD47 has been demonstrated. Especially in cancer, the activated TSP-1 and CD47 pathway has been found to reduce tumor growth and metastasis. See Kale et al. Int J Mol Sci, 22(8) (2021) and Kaur et al. J Biol Chem, 285(50), 38923-38932 (2010). Here, we show that a labeled murine TSP-1 is transferred from RBC to the CT26.CL25 cancer cells.

Murine TSP-1 (7859-TH, R&D Systems) labeled with Cy5.5 was tested for its ability to be transferred from RBC to CD47 present on the surface of CT26.CL25 cells. Experiments were carried out as in Example 2, except that 5 μg of Cy5.5 labeled TSP-1, rather than 500 pmol of conjugate, was incubated with the RBC.

Figure 8:
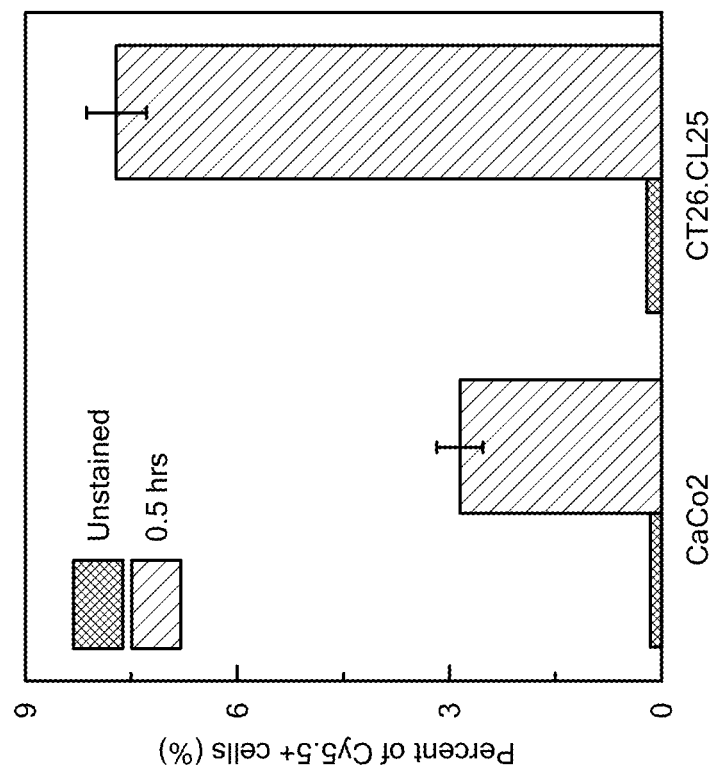
FIG. 8 shows flow cytometry results of CaCO2 cells and CT26.CL25 cells before ("unstained") and after being incubated with red blood cells bound with Cy5.5-labeled murine thrombospondin-1, in accordance with embodiments of the invention.

As shown in the flow cytometry results of FIG. 8, a significantly greater percentage of CT26.CL25 cells demonstrate Cy5.5 fluorescence compared to CaCO2 cells, strongly suggesting that Cy5.5-labeled TSP-1 has been transferred from RBC to CD47 present on the surface of the CT26.CL25 cells.

Example 9: vSIRPα-siRNA Conjugate Binds RBC In Vivo 5 nmol of the vSIRPα-siRNA conjugate from Example 1 and 5 nmol of unconjugated siRNA from Example 1 were each stained with the intercalating dye YOYO™_1 Iodide in a molar ratio of 1:1 in a total volume of 120 µl of RNAse-free water. After incubation for 30 minutes at room temperature, the stained conjugate and siRNA were injected into mice as detailed below.

Three Balb/c mice were used for the experiment: one untreated mouse was used as a negative control; one mouse was injected intravenously at the tail vein with 5 nmol of the unconjugated stained siRNA, and one mouse was injected intravenously at the tail vein with 5 nmol of the stained of the vSIRPα-siRNA conjugate.

45 minutes after injection, blood was collected from the mice. 50 µl of whole blood from each sample was washed twice with 1 ml of DPBS by centrifugation at 500×g for 10 minutes and resuspended in DPBS. The resuspended blood was imaged via confocal microscopy using confocal dishes (SPL 100350) and RBC-associated YOYO™-1 Iodide fluorescence signals were compared between different groups (control, siRNA, and conjugate). A 488 nm laser was used (YOYO™-1 Iodide has an excitation wavelength of 491 nm).

Figure 9:
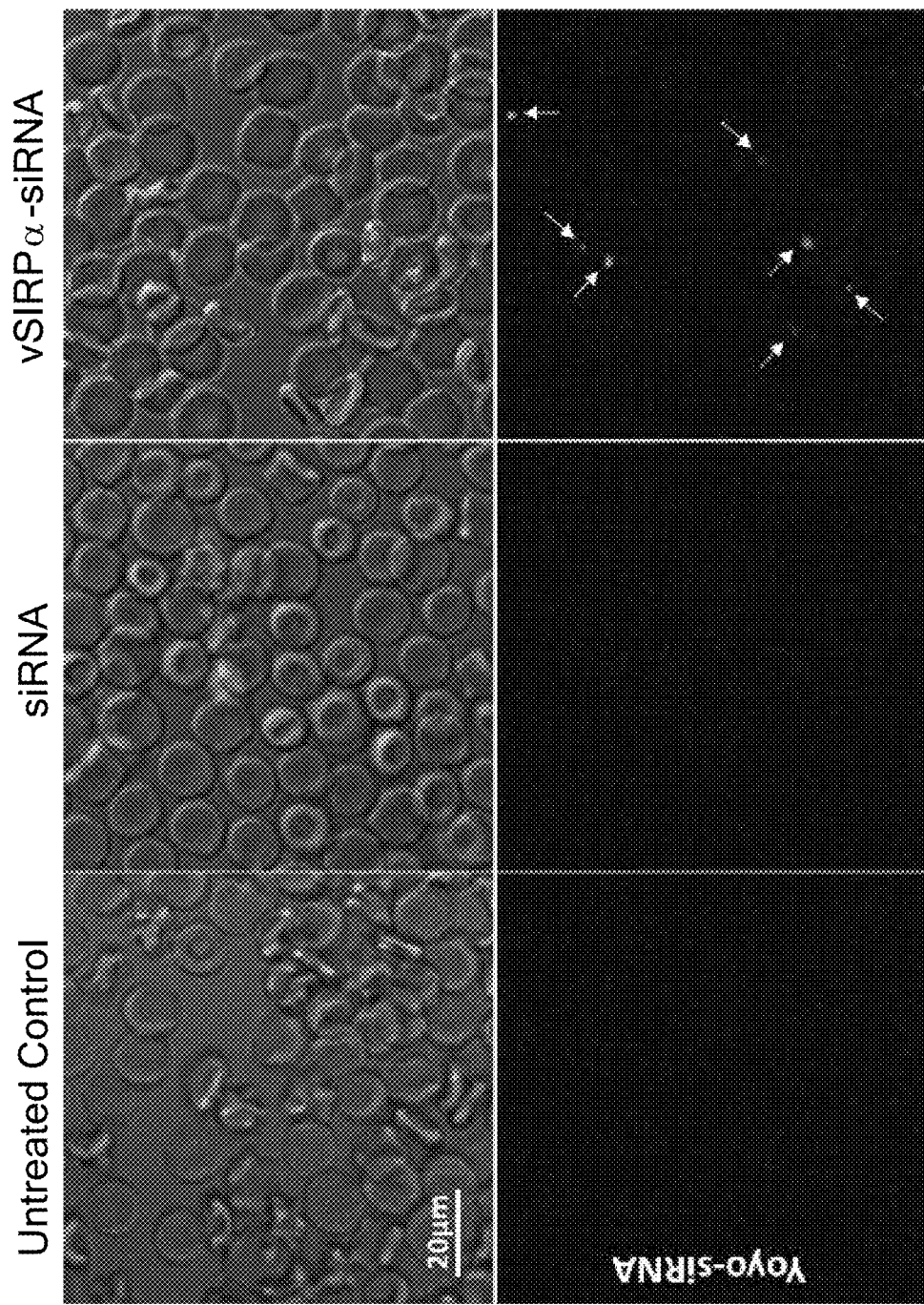
FIG. 9 shows red blood cells isolated from an untreated mouse, a mouse injected with a fluorescently labeled siRNA conjugate, and a mouse injected with a fluorescently labeled vSIRPα-siRNA conjugate, in accordance with embodiments of the invention.

As shown in FIG. 9, RBCs from the mouse injected with the vSIRPα-siRNA conjugate shows fluorescent punctate (arrows of FIG. 9), indicating that binding between the vSIRPα-siRNA conjugate and RBCs occurs in vivo.

Potential Claims

Various embodiments of the present invention may be characterized by the potential claims listed in the paragraphs following this paragraph (and before the actual claims provided at the end of this application). These potential claims form a part of the written description of this application. Accordingly, subject matter of the following potential claims may be presented as actual claims in later proceedings involving this application or any application claiming priority based on this application. Inclusion of such potential claims should not be construed to mean that the actual claims do not cover the subject matter of the potential claims. Thus, a decision to not present these potential claims in later proceedings should not be construed as a donation of the subject matter to the public.

Without limitation, potential subject matter that may be claimed (prefaced with the letter "P" so as to avoid confusion with the actual claims presented below) includes:

P1. A therapeutic compound for RBC-mediated delivery in a mammalian subject to a target cell expressing CD47, the therapeutic compound comprising:
  a CD47-binding protein conjugated to an API so as to form a conjugate;
  wherein the CD47-binding protein is selected from the group consisting of wild type SIRPα (SEQ ID NO: 1), vSIRPα (SEQ ID NO: 3), wild type thrombospondin-1 (TSP-1) (SEQ ID NO: 7), wild type SIRPγ (SEQ ID NO: 4), vSIRPγ-1 (SEQ ID NO: 5), vSIRPγ-2 (SEQ ID NO: 6), ALX148 (SEQ ID NO: 962), TTI-661 (SEQ ID NO: 963), TTI-662 (SEQ ID NO: 964), a homolog of any of the foregoing, and combinations thereof, and is configured to bind the conjugate to CD47 of a red blood cell of the subject so as to enable transport of the conjugate, through the subject's circulatory system, to the target cell, so that (i) the CD47-binding protein, being configured to bind the conjugate to the CD47 of the red blood cell, binds the CD47 of the target cell, thus transferring the conjugate from the red blood cell to the target cell so as to form a conjugate-CD47 complex on the target cell, thereby blocking CD47 and inhibiting CD47 activity as an immune escape mechanism of the target cell, and (ii) the conjugate is taken up by the target cell via endocytosis of the conjugate-CD47 complex, thereby further inhibiting the immune escape mechanism of the target cell and delivering the API into the target cell.

P2. A therapeutic compound for RBC-mediated delivery in a mammalian subject to a target cell expressing CD47, the therapeutic compound comprising:
  a CD47-binding protein conjugated to an API so as to form a conjugate;
  wherein the CD47-binding protein is selected from the group consisting of wild type thrombospondin-1 (TSP-1) (SEQ ID NO: 7), wild type SIRPγ (SEQ ID NO: 4), vSIRPγ-1 (SEQ ID NO: 5), vSIRPγ-2 (SEQ ID NO: 6), ALX148 (SEQ ID NO: 962), TTI-661 (SEQ ID NO: 963), TTI-662 (SEQ ID NO: 964), a homolog of any of the foregoing, and combinations thereof, and is configured to bind the conjugate to CD47 of a red blood cell of the subject so as to enable transport of the conjugate, through the subject's circulatory system, to the target cell, so that (i) the CD47-binding protein, being configured to bind the conjugate to the CD47 of the red blood cell, binds the CD47 of the target cell, thus transferring the conjugate from the red blood cell to the target cell so as to form a conjugate-CD47 complex on the target cell, thereby blocking CD47 and inhibiting CD47 activity as an immune escape mechanism of the target cell, and (ii) the conjugate is taken up by the target cell via endocytosis of the conjugate-CD47 complex, thereby further inhibiting the immune escape mechanism of the target cell and delivering the API into the target cell.

P3. A therapeutic compound for RBC-mediated delivery in a mammalian subject to a target cell expressing CD47, the therapeutic compound comprising:
  a CD47-binding protein conjugated to an API so as to form a conjugate;
  wherein the CD47-binding protein is an anti-CD47 antibody, the anti-CD47 antibody comprising:
  (a) a heavy chain variable region including complementarity determining regions CDR1, CDR2, and CDR3 comprising SEQ ID NO: 932, SEQ ID NO: 933, and SEQ ID NO: 934, respectively, and a light chain variable region including complementarity determining regions CDR1, CDR2, and CDR3 comprising SEQ ID NO: 935, SEQ ID NO: 936, and SEQ ID NO: 937, respectively;
  (b) a heavy chain variable region including complementarity determining regions CDR1, CDR2, and CDR3 comprising SEQ ID NO: 940, SEQ ID NO: 941, and SEQ ID NO: 942, respectively, and a light chain variable region including complementarity determining regions CDR1, CDR2, and CDR3 comprising SEQ ID NO: 943, SEQ ID NO: 944, and SEQ ID NO: 945, respectively;
  (c) a heavy chain variable region including complementarity determining regions CDR1, CDR2, and CDR3 comprising SEQ ID NO: 948, SEQ ID NO: 949, and SEQ ID NO: 950, respectively, and a light chain variable region including complementarity determining regions CDR1, CDR2, and CDR3 comprising SEQ ID NO: 951, SEQ ID NO: 952, and SEQ ID NO: 953, respectively; or
  (d) a heavy chain variable region including complementarity determining regions CDR1, CDR2, and CDR3 comprising SEQ ID NO: 956, SEQ ID NO: 957, and SEQ ID NO: 958, respectively, and a light chain variable region including complementarity determining regions CDR1, CDR2, and CDR3 comprising SEQ ID NO: 959, SEQ ID NO: 960, and SEQ ID NO: 961, respectively; and being configured to bind the conjugate to CD47 of a red blood cell of the subject so as to enable transport of the conjugate, through the subject's circulatory system, to the target cell, so that (i) the CD47-binding protein, being configured to bind the conjugate to the CD47 of the red blood cell, binds the CD47 of the target cell, thus transferring the conjugate from the red blood cell to the target cell so as to form a conjugate-CD47 complex on the target cell, thereby blocking CD47 and inhibiting CD47 activity as an immune escape mechanism of the target cell, and (ii) the conjugate is taken up by the target cell via endocytosis of the conjugate-CD47 complex, thereby further inhibiting the immune escape mechanism of the target cell and delivering the API into the target cell.

P3.5 The therapeutic compound according to claim P3, wherein the anti-CD47 antibody is a humanized antibody.

P4. The therapeutic compound according to any one of the preceding claims, wherein the CD47-binding protein is conjugated to the API by a bond selected from the group consisting of a covalent bond, a hydrogen bond, an ionic bond, a van der Waals interaction, and combinations thereof.

P5. The therapeutic compound according to any one of the preceding potential claims, wherein the CD47-binding protein is conjugated to the API by a linker.

P6. The therapeutic compound according to claim P5, wherein the linker is cleavable.

P7. The therapeutic compound according to any one of claims P5 and P6, wherein the linker is configured to be cleaved by a lysosomal degradative enzyme.

P8. The therapeutic compound according to any one of the preceding potential claims, wherein the API is selected from the group consisting of RNA, DNA, an RNA derivative, a DNA derivative, a protein, and a small molecule.

P9. The therapeutic compound according to any one of claims P1-P7, wherein the API is selected from the group consisting of siRNA, shRNA, miRNA, antimiR, and mRNA.

P10. The therapeutic compound according to any one of the preceding potential claims, wherein the target cell is a cell selected from the group consisting of a cancer cell, a virus infected cell, a fibrotic cell, and combinations thereof.

P11. The therapeutic compound according to any one of claims P1-P9, wherein the target cell is a cancer cell.

P12. The therapeutic compound according to any one of claims P1-P9, wherein the target cell is a virus-infected cell.

P13. The therapeutic compound according to any one of claims P1-P9, wherein the target cell is a fibrotic cell.

P14. The therapeutic compound according to claim P11, wherein the cancer cell is in a tumor attributable to a cancer selected from the group consisting of brain tumor, spinal cord tumor, retinoblastoma, oral cancer, nasal cavity cancer, paranasal sinus cancer, pharyngeal cancer, laryngeal cancer, neck cancer, head and neck cancer, melanoma, skin cancer, breast cancer, thyroid cancer, malignant adrenal tumor, endocrine cancer, lung cancer, pleural tumor, respiratory tract cancer, esophageal cancer, stomach cancer, small intestine cancer, colon cancer, anal cancer, liver cancer, biliary tract cancer, pancreatic cancer, kidney cancer, bladder cancer, prostate cancer, testicular cancer, penile cancer, cervical cancer, endometrial cancer, choriocarcinoma, ovarian cancer, blood cancer including acute/chronic leukemia, malignant lymphoma and multiple myeloma, bone tumor, soft tissue tumor, childhood leukemia, and childhood cancer.

P15. The therapeutic compound according to claim P11, wherein the cancer cell is attributable to a cancer selected from the group consisting of ovarian serous cystadenocarcinoma, lung adenocarcinoma, cervical and endocervical cancer, head and neck squamous cell carcinoma, thyroid carcinoma, uterine corpus endometrioid carcinoma, prostate adenocarcinoma, mesothelioma, diffuse large B-cell lymphoma, acute leukemia, lung squamous cell carcinoma, acute lymphoblastic leukemia, esophageal carcinoma, myxofibrosarcoma, pancreatic adenocarcinoma, rectum adenocarcinoma, colon adenocarcinoma, acute megakaryoblastic leukemia, breast invasive carcinoma, stomach adenocarcinoma, bladder urothelial carcinoma, cholangiocarcinoma, leukemia, thymic carcinoma, leiomyosarcoma, thymoma, undifferentiated pleomorphic sarcoma, uterine carcinosarcoma, acute myeloid leukemia, glioblastoma multiforme, sarcoma, skin cutaneous melanoma, kidney clear cell carcinoma, dedifferentiated liposarcoma, lymphoma, retinoblastoma, neuroblastoma, osteosarcoma, juvenile myelomonocytic leukemia, gastrointestinal stromal tumor, dysembryoplatic neuroepithelial tumor, adrenocortical cancer, acute leukemia of ambiguous lineage, pheochromocytoma and paraganglioma, glioma, testicular germ cell tumor, supratentorial embryonal tumor NOS, neurofibroma, kidney papillary cell carcinoma, hepatocellular carcinoma, kidney chromophobe, malignant peripheral nerve sheath tumor, ependymoma, adrenocortical carcinoma, nasopharyngeal carcinoma, spindle cells/sclerosing rhabdomyosarcoma, melanoma, choroid plexus carcinoma, undifferentiated spindle cell carcinoma, myoepithelial carcinoma, alveolar rhabdomyosarcoma, rhabdomyosarcoma, atypical teratoid/rhabdoid tumor, desmoplastic small round cell tumor, fibromatosis, synovial sarcoma, wilms tumor, myofibromytosis, fibrolamellar hepatocellular carcinoma, undifferentiated sarcoma NOS, embryonal rhabdomyosarcoma, uveal melanoma, Ewing sarcoma, hepatoblastoma, infantile fibrosarcoma, INI-deficient soft tissue sarcoma NOA, undifferentiated hepatic sarcoma, and medulloblastoma.

P16. The therapeutic compound according to claim P12, wherein the virus-infected cell is infected with a SARS-CoV-2 virus.

P17. The therapeutic compound according to claim P13, wherein the fibrotic cell is associated with cystic fibrosis.

P18. The therapeutic compound according to any one of claims P1-P7, P10, P11, P14, and P15, wherein the API is siRNA, the siRNA being a double-stranded RNA molecule including an antisense RNA strand and a sense RNA strand, wherein:

(a) the antisense RNA strand is 19-29 nucleotides in length and is complementary to contiguous nucleotides in a target mammalian mRNA sequence, the mRNA sequence being selected from the group consisting of SEQ ID NO: 8-747 and 771-824, (b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length.

P19. The therapeutic compound according to any one of claims P1-P7, P10, P11, P14, and P15, wherein the API is siRNA, the siRNA being a double-stranded RNA molecule including an antisense RNA strand and a sense RNA strand, wherein:

(a) the antisense RNA strand is 19-29 nucleotides in length and is complementary to contiguous nucleotides in a target mammalian mRNA sequence, the mRNA sequence being selected from the group consisting of SEQ ID NO: 22-747 and 771-824,
(b) the sense RNA strand is 19-29 nucleotides in length and is complementary to 14-29 nucleotides from the antisense RNA strand, and
(c) the double stranded RNA molecule has a double stranded region of 14-29 nucleotides in length and a 3' overhang region of 0-5 nucleotides in length.

P20. The therapeutic compound according to any one of claims P1-P7, P10, P11, P14, and P15, wherein the API is siRNA, the siRNA being a double-stranded RNA molecule including an antisense RNA strand and a sense RNA strand, wherein:
(a) the antisense RNA strand is 19-29 nucleotides in length and is complementary to contiguous nucleotides in a target mammalian mRNA sequence, the mRNA sequence being selected from the group consisting of SEQ ID NO: 22-37,
(b) the sense RNA strand is 19-29 nucleotides in length and is complementary to 14-29 nucleotides from the antisense RNA strand, and
(c) the double stranded RNA molecule has a double stranded region of 14-29 nucleotides in length and a 3' overhang region of 0-5 nucleotides in length.

P21. The therapeutic compound according to any one of claims P1-P7, P10, P11, P14, and P15, wherein the API is siRNA, the siRNA being a double-stranded RNA molecule including an antisense RNA strand and a sense RNA strand, wherein:
(a) the antisense RNA strand is 19-29 nucleotides in length and is complementary to contiguous nucleotides in a target mammalian mRNA sequence, the mRNA sequence being selected from the group consisting of SEQ ID NO: 38-39,
(b) the sense RNA strand is 19-29 nucleotides in length and is complementary to 14-29 nucleotides from the antisense RNA strand, and
(c) the double stranded RNA molecule has a double stranded region of 14-29 nucleotides in length and a 3' overhang region of 0-5 nucleotides in length.

P22. The therapeutic compound according to any one of claims P1-P7, P10, P11, P14, and P15, wherein the API is siRNA, the siRNA being a double-stranded RNA molecule including an antisense RNA strand and a sense RNA strand, wherein:
(a) the antisense RNA strand is 19-29 nucleotides in length and is complementary to contiguous nucleotides in a target mammalian mRNA sequence, the mRNA sequence being selected from the group consisting of SEQ ID NO: 40-43,
(b) the sense RNA strand is 19-29 nucleotides in length and is complementary to 14-29 nucleotides from the antisense RNA strand, and
(c) the double stranded RNA molecule has a double stranded region of 14-29 nucleotides in length and a 3' overhang region of 0-5 nucleotides in length.

P23. The therapeutic compound according to any one of claims P1-P7, P10, P11, P14, and P15, wherein the API is siRNA, the siRNA being a double-stranded RNA molecule including an antisense RNA strand and a sense RNA strand, wherein:
(a) the antisense RNA strand is 19-29 nucleotides in length and is complementary to contiguous nucleotides in a target mammalian mRNA sequence, the mRNA sequence being selected from the group consisting of SEQ ID NO: 44-51,
(b) the sense RNA strand is 19-29 nucleotides in length and is complementary to 14-29 nucleotides from the antisense RNA strand, and
(c) the double stranded RNA molecule has a double stranded region of 14-29 nucleotides in length and a 3' overhang region of 0-5 nucleotides in length.

P24. The therapeutic compound according to any one of claims P1-P7, P10, P12, and P16, wherein the API is siRNA, the siRNA being a double-stranded RNA molecule including an antisense RNA strand and a sense RNA strand, wherein:
(a) the antisense RNA strand is 19-29 nucleotides in length and is complementary to contiguous nucleotides in a target mammalian mRNA sequence, the mRNA sequence being selected from the group consisting of SEQ ID NO: 8-21, 482-486, and 748-765,
(b) the sense RNA strand is 19-29 nucleotides in length and is complementary to 14-29 nucleotides from the antisense RNA strand, and
(c) the double stranded RNA molecule has a double stranded region of 14-29 nucleotides in length and a 3' overhang region of 0-5 nucleotides in length.

P25. The therapeutic compound according to any one of claims P1-P7, P10, P12, and P16, wherein the API is siRNA, the siRNA being a double-stranded RNA molecule including an antisense RNA strand and a sense RNA strand, wherein:
(a) the antisense RNA strand is 19-29 nucleotides in length and is complementary to contiguous nucleotides in a target mammalian mRNA sequence, the mRNA sequence being selected from the group consisting of SEQ ID NO: 482-486 and 748-765,
(b) the sense RNA strand is 19-29 nucleotides in length and is complementary to 14-29 nucleotides from the antisense RNA strand, and
(c) the double stranded RNA molecule has a double stranded region of 14-29 nucleotides in length and a 3' overhang region of 0-5 nucleotides in length.

P26. The therapeutic compound according to any one of claims P1-P7, P10, P13, and P17, wherein the API is siRNA, the siRNA being a double-stranded RNA molecule including an antisense RNA strand and a sense RNA strand, wherein:
(a) the antisense RNA strand is 19-29 nucleotides in length and is complementary to contiguous nucleotides in a target mammalian mRNA sequence, the mRNA sequence being selected from the group consisting of SEQ ID NO: 8-21, 40-43, and 766-770,
(b) the sense RNA strand is 19-29 nucleotides in length and is complementary to 14-29 nucleotides from the antisense RNA strand, and
(c) the double stranded RNA molecule has a double stranded region of 14-29 nucleotides in length and a 3' overhang region of 0-5 nucleotides in length.

P27. The therapeutic compound according to any one of claims P1-P7, P10, P13, and P17, wherein the API is siRNA, the siRNA being a double-stranded RNA molecule including an antisense RNA strand and a sense RNA strand, wherein:
(a) the antisense RNA strand is 19-29 nucleotides in length and is complementary to contiguous nucleotides in a target mammalian mRNA sequence, the mRNA sequence being selected from the group consisting of SEQ ID NO: 40-43 and 766-770,
(b) the sense RNA strand is 19-29 nucleotides in length and is complementary to 14-29 nucleotides from the antisense RNA strand, and (c) the double stranded RNA molecule has a double stranded region of 14-29 nucleotides in length and a 3' overhang region of 0-5 nucleotides in length.

P28. The therapeutic compound according to any one of claims P1-P7, P10, P11, P14, and P15, wherein the API is shRNA, the shRNA being a single-stranded RNA molecule of 44-71 nucleotides in length, and having, in a 5' to 3' direction:
- a first region of 19-29 nucleotides at the 5' end of the single-stranded RNA molecule, the first region having a first sequence;
- a second region of 4-11 nucleotides directly adjacent to the first region, the second region having a second sequence;
- a third region of 19-29 nucleotides directly adjacent to the second region, the third region having a third sequence; and
- a fourth region of 2 nucleotides at the 3' end of the single-stranded RNA molecule, directly adjacent to the third region, the fourth region having a fourth sequence, wherein:
(a) the first region has the same number of nucleotides as the third region,
(b) the third sequence is the reverse-complement of the first sequence,
(c) the third region is complementary to contiguous nucleotides in a target mammalian mRNA sequence, the mRNA sequence being selected from the group consisting of SEQ ID NO: 8-747 and 771-824, and
(d) the single-stranded RNA molecule is configured to form a stem loop structure, the first region base pairing with the third region to form a stem, the second region forming a loop, and the fourth region forming a 3' overhang.

P29. The therapeutic compound according to any one of claims P1-P7, P10, P11, P14, and P15, wherein the API is shRNA, the shRNA being a single-stranded RNA molecule of 44-71 nucleotides in length, and having, in a 5' to 3' direction:
- a first region of 19-29 nucleotides at the 5' end of the single-stranded RNA molecule, the first region having a first sequence;
- a second region of 4-11 nucleotides directly adjacent to the first region, the second region having a second sequence;
- a third region of 19-29 nucleotides directly adjacent to the second region, the third region having a third sequence; and
- a fourth region of 2 nucleotides at the 3' end of the single-stranded RNA molecule, directly adjacent to the third region, the fourth region having a fourth sequence, wherein:
(a) the first region has the same number of nucleotides as the third region,
(b) the third sequence is the reverse-complement of the first sequence,
(c) the third region is complementary to contiguous nucleotides in a target mammalian mRNA sequence, the mRNA sequence being selected from the group consisting of SEQ ID NO: 22-747 and 771-824, and
(d) the single-stranded RNA molecule is configured to form a stem loop structure, the first region base pairing with the third region to form a stem, the second region forming a loop, and the fourth region forming a 3' overhang.

P30. The therapeutic compound according to any one of claims P1-P7, P10, P11, P14, and P15, wherein the API is shRNA, the shRNA being a single-stranded RNA molecule of 44-71 nucleotides in length, and having, in a 5' to 3' direction:
- a first region of 19-29 nucleotides at the 5' end of the single-stranded RNA molecule, the first region having a first sequence;
- a second region of 4-11 nucleotides directly adjacent to the first region, the second region having a second sequence;
- a third region of 19-29 nucleotides directly adjacent to the second region, the third region having a third sequence; and
- a fourth region of 2 nucleotides at the 3' end of the single-stranded RNA molecule, directly adjacent to the third region, the fourth region having a fourth sequence, wherein:
(a) the first region has the same number of nucleotides as the third region,
(b) the third sequence is the reverse-complement of the first sequence,
(c) the third region is complementary to contiguous nucleotides in a target mammalian mRNA sequence, the mRNA sequence being selected from the group consisting of SEQ ID NO: 22-37, and
(d) the single-stranded RNA molecule is configured to form a stem loop structure, the first region base pairing with the third region to form a stem, the second region forming a loop, and the fourth region forming a 3' overhang.

P31. The therapeutic compound according to any one of claims P1-P7, P10, P11, P14, and P15, wherein the API is shRNA, the shRNA being a single-stranded RNA molecule of 44-71 nucleotides in length, and having, in a 5' to 3' direction:
- a first region of 19-29 nucleotides at the 5' end of the single-stranded RNA molecule, the first region having a first sequence;
- a second region of 4-11 nucleotides directly adjacent to the first region, the second region having a second sequence;
- a third region of 19-29 nucleotides directly adjacent to the second region, the third region having a third sequence; and
- a fourth region of 2 nucleotides at the 3' end of the single-stranded RNA molecule, directly adjacent to the third region, the fourth region having a fourth sequence, wherein:
(a) the first region has the same number of nucleotides as the third region,
(b) the third sequence is the reverse-complement of the first sequence,
(c) the third region is complementary to contiguous nucleotides in a target mammalian mRNA sequence, the mRNA sequence being selected from the group consisting of SEQ ID NO: 38-39, and
(d) the single-stranded RNA molecule is configured to form a stem loop structure, the first region base pairing with the third region to form a stem, the second region forming a loop, and the fourth region forming a 3' overhang.

P32. The therapeutic compound according to any one of claims P1-P7, P10, P11, P14, and P15, wherein the API is shRNA, the shRNA being a single-stranded RNA molecule of 44-71 nucleotides in length, and having, in a 5' to 3' direction:
- a first region of 19-29 nucleotides at the 5' end of the single-stranded RNA molecule, the first region having a first sequence;
- a second region of 4-11 nucleotides directly adjacent to the first region, the second region having a second sequence;
- a third region of 19-29 nucleotides directly adjacent to the second region, the third region having a third sequence; and
- a fourth region of 2 nucleotides at the 3' end of the single-stranded RNA molecule, directly adjacent to the third region, the fourth region having a fourth sequence, wherein:
- (a) the first region has the same number of nucleotides as the third region,
- (b) the third sequence is the reverse-complement of the first sequence,
- (c) the third region is complementary to contiguous nucleotides in a target mammalian mRNA sequence, the mRNA sequence being selected from the group consisting of SEQ ID NO: 40-43, and
- (d) the single-stranded RNA molecule is configured to form a stem loop structure, the first region base pairing with the third region to form a stem, the second region forming a loop, and the fourth region forming a 3' overhang.

P33. The therapeutic compound according to any one of claims P1-P7, P10, P11, P14, and P15, wherein the API is shRNA, the shRNA being a single-stranded RNA molecule of 44-71 nucleotides in length, and having, in a 5' to 3' direction:
- a first region of 19-29 nucleotides at the 5' end of the single-stranded RNA molecule, the first region having a first sequence;
- a second region of 4-11 nucleotides directly adjacent to the first region, the second region having a second sequence;
- a third region of 19-29 nucleotides directly adjacent to the second region, the third region having a third sequence; and
- a fourth region of 2 nucleotides at the 3' end of the single-stranded RNA molecule, directly adjacent to the third region, the fourth region having a fourth sequence, wherein:
- (a) the first region has the same number of nucleotides as the third region,
- (b) the third sequence is the reverse-complement of the first sequence,
- (c) the third region is complementary to contiguous nucleotides in a target mammalian mRNA sequence, the mRNA sequence being selected from the group consisting of SEQ ID NO: 44-51, and
- (d) the single-stranded RNA molecule is configured to form a stem loop structure, the first region base pairing with the third region to form a stem, the second region forming a loop, and the fourth region forming a 3' overhang.

P34. The therapeutic compound according to any one of claims P1-P7, P10, P12, and P16, wherein the API is shRNA, the shRNA being a single-stranded RNA molecule of 44-71 nucleotides in length, and having, in a 5' to 3' direction:
- a first region of 19-29 nucleotides at the 5' end of the single-stranded RNA molecule, the first region having a first sequence;
- a second region of 4-11 nucleotides directly adjacent to the first region, the second region having a second sequence;
- a third region of 19-29 nucleotides directly adjacent to the second region, the third region having a third sequence; and
- a fourth region of 2 nucleotides at the 3' end of the single-stranded RNA molecule, directly adjacent to the third region, the fourth region having a fourth sequence, wherein:
- (a) the first region has the same number of nucleotides as the third region,
- (b) the third sequence is the reverse-complement of the first sequence,
- (c) the third region is complementary to contiguous nucleotides in a target mammalian mRNA sequence, the mRNA sequence being selected from the group consisting of SEQ ID NO: 8-21, 482-486, and 748-765, and
- (d) the single-stranded RNA molecule is configured to form a stem loop structure, the first region base pairing with the third region to form a stem, the second region forming a loop, and the fourth region forming a 3' overhang.

P35. The therapeutic compound according to any one of claims P1-P7, P10, P12, and P16, wherein the API is shRNA, the shRNA being a single-stranded RNA molecule of 44-71 nucleotides in length, and having, in a 5' to 3' direction:
- a first region of 19-29 nucleotides at the 5' end of the single-stranded RNA molecule, the first region having a first sequence;
- a second region of 4-11 nucleotides directly adjacent to the first region, the second region having a second sequence;
- a third region of 19-29 nucleotides directly adjacent to the second region, the third region having a third sequence; and
- a fourth region of 2 nucleotides at the 3' end of the single-stranded RNA molecule, directly adjacent to the third region, the fourth region having a fourth sequence, wherein:
- (a) the first region has the same number of nucleotides as the third region,
- (b) the third sequence is the reverse-complement of the first sequence,
- (c) the third region is complementary to contiguous nucleotides in a target mammalian mRNA sequence, the mRNA sequence being selected from the group consisting of SEQ ID NO: 482-486 and 748-765, and
- (d) the single-stranded RNA molecule is configured to form a stem loop structure, the first region base pairing with the third region to form a stem, the second region forming a loop, and the fourth region forming a 3' overhang.

P36. The therapeutic compound according to any one of claims P1-P7, P10, P13, and P17, wherein the API is shRNA, the shRNA being a single-stranded RNA molecule of 44-71 nucleotides in length, and having, in a 5' to 3' direction:

a first region of 19-29 nucleotides at the 5' end of the single-stranded RNA molecule, the first region having a first sequence;

a second region of 4-11 nucleotides directly adjacent to the first region, the second region having a second sequence;

a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein:

(a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 8-21, 40-43, and 766-770, and (d) the single-stranded RNA molecule is configured to form a stem loop structure, the first region base pairing with the third region to form a stem, the second region forming a loop, and the fourth region forming a 3' overhang.

P37. The therapeutic compound according to any one of claims P1-P7, P10, P13, and P17, wherein the API is shRNA, the shRNA being a single-stranded RNA molecule of 44-71 nucleotides in length, and having, in a 5' to 3' direction:

a first region of 19-29 nucleotides at the 5' end of the single-stranded RNA molecule, the first region having a first sequence;

a second region of 4-11 nucleotides directly adjacent to the first region, the second region having a second sequence;

a third region of 19-29 nucleotides directly adjacent to the second region, the third region having a third sequence; and a fourth region of 2 nucleotides at the 3' end of the single-stranded RNA molecule, directly adjacent to the third region, the fourth region having a fourth sequence, wherein:

(a) the first region has the same number of nucleotides as the third region, (b) the third sequence is the reverse-complement of the first sequence, (c) the third region is complementary to contiguous nucleotides in a target mammalian mRNA sequence, the mRNA sequence being selected from the group consisting of SEQ ID NO: 40-43 and 766-770, and (d) the single-stranded RNA molecule is configured to form a stem loop structure, the first region base pairing with the third region to form a stem, the second region forming a loop, and the fourth region forming a 3' overhang.

P38. The therapeutic compound according to any one of claims P1-P7, P10, P11, P14, and P15, wherein the API is an miRNA selected from the group consisting of SEQ ID NO: 825-844, 849-851, 853, 855, 857, 864, 865, and 867-883.

P39. The therapeutic compound according to any one of claims P1-P7, P10, P11, P14, and P15, wherein the API is an antimiR, the antimiR being a single-stranded nucleic acid molecule of 12-25 nucleotides in length, the antimiR having a sequence of 12-25 contiguous nucleotides that is complementary to contiguous nucleotides in a target mature miRNA product sequence, the mature miRNA product sequence being selected from the group consisting of SEQ ID NO: 884-908, wherein the contiguous nucleotides in the mature miRNA product sequence includes, in a 5' to 3' direction, nucleotides 2 to 8 of the mature miRNA product sequence.

P40. The therapeutic compound according to any one of claims P1-P7, P10, P11, P14, and P15, wherein the API is a small molecule selected from the group consisting of methotrexate; doxorubicin; vinca alkaloids; camptothecin analogues; microtubule-disrupting agents such as auristatins (e.g., MMAE and MMAF) and maytansinoids (e.g., DM1 and DM4); and DNA-damaging agents such as DNA topoisomerase I inhibitors (e.g., SN-38 and exatecan), double-strand break agents (e.g., calicheamicin), cross-linkers (e.g., pyrrolobenzodiazepine dimer-PBD), and alkylators (e.g., duocarmycin and indolinobenzodiazepine dimer-IGN).

P41. The therapeutic compound according to any one of claims P1-P7, P10, P11, P14, and P15, wherein the API is a protein, the protein having an amino acid sequence selected from the group consisting of SEQ ID NO: 909-929 and homologs thereof.

P42. The therapeutic compound according to any one of claims P1-P7, P10, P11, P14, and P15, wherein the API is a protein, the protein consisting of an amino acid sequence selected from the group consisting of SEQ ID NO: 909-929 and homologs thereof.

P43. The therapeutic compound according to any one of claims P1-P7, P10, P11, P14, and P15, wherein the API is an mRNA encoding an amino acid sequence selected from the group consisting of SEQ ID NO: 909-929 and homologs thereof, the mRNA being configured to be translated in the target cell to produce a protein comprising the amino acid sequence.

P44. The therapeutic compound according to any one of claims P1-P7, P10, P11, P14, and P15, wherein the API is an mRNA encoding an amino acid sequence selected from the group consisting of SEQ ID NO: 909-929 and homologs thereof, the mRNA being configured to be translated in the target cell to produce a protein consisting of the amino acid sequence.

P45. The therapeutic compound according to any one of claims P43 and P44, wherein the mRNA is codon optimized.

P46. A method of treating cancer in a mammalian subject in need thereof, the method comprising administering a therapeutically effective amount of the therapeutic compound according to any one of claims P1-P1, P14, P15, P18-P23, P28-P33, and P38-P45.

P47. A method of treating viral infection in a mammalian subject in need thereof, the method comprising administering a therapeutically effective amount of the therapeutic compound according to any one of claims P1-P10, P12, P16, P24, P25, P34, and P35.

P48. A method of treating fibrotic disease in a mammalian subject in need thereof, the method comprising administering a therapeutically effective amount of the therapeutic compound according to any one of claims P1-P10, P13, P17, P26, P27, P36, and P37.

P49. The therapeutic compound according to any one of claims P1-P45, wherein the mammalian subject is a human.

P50. The method according to any one of claims P46-P48, wherein the mammalian subject is a human.

P51. A pharmaceutical composition comprising the therapeutic compound according to any one of claims P1-P45 and P49 and a pharmaceutically acceptable carrier.

The embodiments of the invention described above are intended to be merely exemplary; numerous variations and modifications will be apparent to those skilled in the art. All such variations and modifications are intended to be within the scope of the present invention as defined in any appended claims.

SEQUENCE LISTING (966 sequences)

SEQ ID NO: 1 - protein, 118 aa, Homo sapiens
  source 1..118: note = Human wild type SIRP alpha
EEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKP

SEQ ID NO: 2 - protein, 119 aa, Mus sp.
  source 1..119: note = Mouse balb/c wild type SIRP alpha
ATGTEVKVTQPEKSVSVAAGDSTILNCTVTSLLPVGPIRWYRGVGQSRLLIYSFTGEHFPRVRNVSDTTKRNNMDFSIRISNVTPEDAGTYYCVKFQRGSSEPDTEIQSGGGTEVYVLA

SEQ ID NO: 3 - protein, 118 aa, synthetic construct
  source 1..118: note = Human variant SIRP alpha
EEELQIIQPDKSVLVAAGETATLRCTITSLFPVGPIQWFRGAGPGRVLIYNQRQGPFPRVTTVSDTTKRNNMDFSIRIGNITPADAGTYYCIKFRKGSPDDVEFKSGAGTELSVRAKP

SEQ ID NO: 4 - protein, 119 aa, Homo sapiens
  source 1..119: note = Human wild type SIRP gamma
EEELQMIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGAKPS

SEQ ID NO: 5 - protein, 118 aa, synthetic construct
  source 1..118: note = Human variant SIRP gamma-1
EEELQIIQPEKLLLVTVGKTATLHCTITSLFPVGPVLWFRGVGPGRVLIYNQRQGPFPRVTTVSDTTKRNNMDFSIRISSITPADVGTYYCIKFRKGSPENVEFKSGPGTEMALGAKP

SEQ ID NO: 6 - protein, 118 aa, synthetic construct
  source 1..118: note = Human variant SIRP gamma-2
EEELQIIQPEKLLLVTVGKTATLHCTVTSLFPVGPVLWFRGVGPGRVLIYNQRQGPFPRVTTVSDTTKRNNMDFSIRISSITPADVGTYYCIKFRKGSPENVEFKSGPGTEMALGAKP

SEQ ID NO: 7 - protein, 1170 aa, Homo sapiens
  source 1..1170: note = Human wild type Thrombospondin-1
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 8 - RNA, 5292 nt, Homo sapiens
  source 1..5292: mol_type = unassigned RNA; note = Homo sapiens CD47 molecule (CD47), transcript variant 1, mRNA, NCBI Reference Sequence: NM_001777.4
gcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagctattttgttgggctatttctattgctgctacagcagaccacaagcacatttctgaaaaatttaatttattaatgtatttttaagttgcttatattctaggtaacaatgtaaagaatgatttaaaatattaattatgaattttttgagtataatacccaataagcttttaattagagcagagttttaattaaaagttttaaatcagtccaa

SEQ ID NO: 9 - RNA, 5234 nt, Homo sapiens
  source 1..5234: mol_type = unassigned RNA; note = Homo sapiens CD47 molecule (CD47), transcript variant 2, mRNA, NCBI Reference Sequence: NM_198793.3
gcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagctattttgttgggctatttctattgctgctacagcagaccacaagcacatttctgaaaaatttaatttattaatgtatttttaagttgcttatattctaggtaacaatgtaaagaatgatttaaaatattaattatgaattttttgagtataatacccaataagcttttaattagagcagagttttaattaaaagttttaaatcagtccaa

SEQ ID NO: 10 - RNA, 5259 nt, Homo sapiens
  source 1..5259: mol_type = unassigned RNA; note = Homo sapiens CD47 molecule (CD47), transcript variant 3, mRNA, NCBI Reference Sequence: NM_001382306.1
gcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagctattttgttgggctatttctattgctgctacagcagaccacaagcacatttctgaaaaatttaatttattaatgtatttttaagttgcttatattctaggtaacaatgtaaagaatgatttaaaatattaattatgaattttttgagtataatacccaataagcttttaattagagcagagttttaattaaaagttttaaatcagtccaa

SEQ ID NO: 11 - RNA, 5008 nt, Homo sapiens
  source 1..5008: mol_type = unassigned RNA; note = Homo sapiens CD47 molecule (CD47), transcript variant X11, mRNA, NCBI Reference Sequence: XM_005247909.2
gtgcgcgcggccgtgcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 12 - RNA, 5016 nt, Homo sapiens
  source 1..5016: mol_type = unassigned RNA; note = Homo sapiens CD47 molecule (CD47), transcript variant X12, mRNA, NCBI Reference Sequence: XM_017007536.1
ctcattctatttattcttttaacaacgatttgttgagtacatactatgtgtcaggcaaaggggctagcagtaaagaagactcatatggtccctcccctcattgagcttacagtataggaaacagttattactgaacacgaagacagctatataaacataatttcaataaaagatggtaactgatatgcaccaaagtaagactaaaacacagagaagtgcacttaacttatactggcattatcatgggccttgatttactgtgggatcctttgctgttatgttcccttacgttgaaagatgcatctggccctacacaaagcacagactatgagtaggtaggcacatacagttctaagccaaccccttggggcaccaggagacagcactgtctcatgtcgttgcatgacacaccaccatggggcaaaacatttgctgaatgaagttacaataaggatacaattgtatctacataaacatttaaagatactatcatatcaatacctactatgtggcaggatcttgatgttgtgtggggaggaagataaaagtagatgtatcgttgagacagaaatgagggcaagggaaattttttatgcattgagagaggaagtttgtgaattttttcgctggccatggagtcagggagacttcagtccaaccaccgtccctccctgagcttgtgaccaagcctcactttccttatctataaaggtgacaagagtgatttttttaagtttatttatctgtaaaggggaaactgtagcaactttgctattatagggtaaaaagaaaaaaggatgaaaaccagaacaagggagagagacaagagagagagcagtgtcacttataactgtgggcaaagtgctcaccattcctctttccctttgtttcctcatctcaaaaagggagatcataacatttatcctttctgaggttgttatgaagattaacttaggtgatatagctaatgtgtacttcctgtgttcaaaacattctaatatgtattatcccctccctctctacccaagaaactccttacatacagataagatgagctcaacatccaaattaaaatgctttgaaaagttaaaaggcaaacctttaaaatgattaaatactgaaaagagcttaaggttatctcagagagaggataatcaaacctaggcaggctgctttggactgtctctcctgggatatgcctgcttttgccccaccaccaaaacataccccagctagattcccaagagcagcagtggtcacccaggtggcctctcattccattttctgcacaaaaagacgttaagcatatagctcagtagctcccagtgtaaaacagaacatcacccgatctccacctctgaaggttggggacagtcctttctagtcactcttcagctttaggggggttggttggtatcagggacagctgacagccttatttagccaaccagctgctctgtgatacacaatgtccctaatgctcaaagtctggtggatgattcttttgtatccacataagcagcagttggaggagaatcgatgagtccctttggttgcctcggggtgtcaaggctgccattcaaatcattaccaccataattattaaccattgttttagtgagatgtctgccaggcaattgtttttatttttcaatcattaaaaaagcaatcaaatttcactagagcaatgcctgcctcacgccgcatcaacacatttattaaaccccttctgtttgccgagctcaatggaaagtcttggaggagggaatacttaaaatgctctcggatttaaaagaattgataatgctgtggggaagaggttcacacaaaaaagcaattacaggaagaagctcgatagtatacaatacactggtacagagtgtcatagacagtgccactttcatacgctggattttatttctgtggcaatgggatgcttgggaggagccgcactgtgtagaggatttggagaagtggggtattgtggtgggaaattgctttctttcccaggaggtaggaggaaaacaatcaaggaggtggacaggatgtgcactccattagagcagccaccagagcctgactttttgataagagagtacatcagttaggataacggttaaaagtatctttaaaagacttttgcttcaggatgaatgatgtggcctgtgtgattcagcgataaattcaaaagccttgtccctattgtggcttgcggccacatttcgaacccatttttcaagcatgttaaacccaagcgcagcgcagagggctgcacatggggcagtcacaaaccaagctcaataaccttgctggtggggatgtgttggatacgctgctaatgcctgtttgcgacaatgctcgctagtcccggtggtggcggtgttcacaggtaacaatgtttaccaccgtgaatggaacttgtttgattaaccctgatcagaggatgaaaacactaaagaaccaagtgagaaagagggaagagaaccgcatagggaagagcagagcgagtagacgagccgaacgcagagcccgcgaggggcgagtggaagctccctgcgggcaggtacccgaccaccgccctgccctgggcgtggcggcctcgggctcagggaccgcttcggcgctagacggccgcgtccggaggaaacgggcgctggtgaaagcctaggtgtcctggtccacgcgcgcagccggacgtcgggtccagggagagacgcgggctggggcgggacgggacccggcccctgaagcgcgagggtgggagtgaaagcaaagaggagaaaagtagagagagaggacagtggggcccagcgccgcgcgaaaggcaggaaccgacccgcggacaggaacgggtgcaatgaggtccccggcgagcgtgggaacacagggttcagcctcctgcggcgggcgagcacgcggaccccaggggcgggcgggtgcgacaggacgtgacctggaagcgcggcgcgtgccaccgccctggagcaggcatccggcctccgtggagcgggcaggcgggccccgggtctggagcctgcgactggggagggcgccgcgtcaacagcagcggttgcggggcggggccgagtgcgcgtgcgcggctctcgcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggagcgaagaggacgtaaaggacacaattaagtttcattttcaactcagcattcaatcagaagaatcttccggccgtgtaatttttgctgtcgtttttaatcctaaaaataagcttgctggaaactcttcctttctcgtgaccctcacgccccatcagccacttgcatacattctaaattgtacgttgaagtttttcccactttatttgggggaaccgttttaaaagtaatctggttttcgcctgaaataggaagacagtaacctccagtcaaaacatgtgcagcagaatgggatttggtgtttttcgacgccaaagaacctccacccccccacccccaccccgagcttttggaatccatttcgcttttgtaaaacgtgtgcttcgtctgtaaaaactgagcaaggaatagaaacattcgtagctctacagtgagtgcctgtcacacttcacatccatagagccttttgtgaacttttataagattcagaattcagcttgagcaccagtgacagcaattgttacatttattctagaatgctaaattaattcgattttaaactgattattagcctcggtgtgccgttcctaaaggcttgtgactttaggtatttccaagatgcccttaagtctctgcttaccactttcctccctccccgagcatcctggatgttgggactgtgaatccaggtctccgttatctaaatggttgatgttagtgtttcctgtcatcacgtttagtatgcttgttgcctttactatcattatagctaaaataatactgctttcagagatgtgttgtataatcgcataataatttcagaacgccttcatattgaaccagatatgaagtgatacagtatcatttattcaaactgcctaaaaagtaaaaagtataaaccatatactatttttaaaacaggtaggttagatttaaatcacgtagtttagaactgttggaatggtactttgagtgataggatttatgttaggccttctttagtaatagttaatatcatgtaattagcactcgtttacacacaattttaatgtgttcgaatccctagagtcatcgaattcagaatttatagtattttattttacttagttaatattaacctaaaaaaaaagcaaaatacaggcattatgcagttgagttgtgttaagtgtggactgtaaaacaggatagtatttgttataaaatatgtttttgtatgtgtttaatatatagcttcaaaaggacatgtatgaagaaagatgtctcagcacataggtagttataaaccaagggtttgagagactgactttagaatctagaatgagtaagaaagtgatggatctgtacattcatttgtattgaagtttgattttgctttcagtttcgttaattaagccccgggaatcagggacctttcctggcaccctctacagtgttagtggcctttgtggtaaaagaagttatctcagatactcatttcatgcaattacaggcaaactggaaggcaccttaatggtatgcaagatgtgaaatgaattactatgttgcattccactctgcccccactcatgtacaattatactttgtttaaaagtgcatagtttcagtggtatttattagctagcaaataaaactttaaataaataatgatggtgttgtgaactgtcttttcagtggttgaa

SEQ ID NO: 13 - RNA, 5145 nt, Homo sapiens
  source 1..5145: mol_type = unassigned RNA; note = Homo sapiens CD47 molecule (CD47), transcript variant X5, misc_RNA, NCBI Reference Sequence: XR_241521.2
gtgcgcgcggccgtgcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggggttcagagggacacctacagtcagttgaaaggcaagaagagacaagcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 14 - RNA, 5087 nt, Homo sapiens
  source 1..5087: mol_type = unassigned RNA; note = Homo sapiens CD47 molecule (CD47), transcript variant X4, misc_RNA, NCBI Reference Sequence: XR_241522.2
gtgcgcgcggccgtgcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggggttcagagggacacctacagtcagttgaaaggcaagaagagacaagcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 15 - RNA, 5112 nt, Homo sapiens
  source 1..5112: mol_type = unassigned RNA; note = Homo sapiens CD47 molecule (CD47), transcript variant X6, misc_RNA, NCBI Reference Sequence: XR_924218.2
gtgcgcgcggccgtgcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggggttcagagggacacctacagtcagttgaaaggcaagaagagacaagcttccaatcagaagactatacaacctcctaggaaagctgtagaggaaccccttaatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 16 - RNA, 5183 nt, Homo sapiens
  source 1..5183: mol_type = unassigned RNA; note = Homo sapiens CD47 molecule (CD47), transcript variant X7, misc_RNA, NCBI Reference Sequence: XR_924219.2
gtgcgcgcggccgtgcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggggttcagagggacacctacagtcagttgaaaggcaagaagagacaagaatgggccagccaactgtgacatcccttggatcggagatttagaactagaaagtattctttctacattattagggaagaaaaggagttacttggcgcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 17 - RNA, 5161 nt, Homo sapiens
  source 1..5161: mol_type = unassigned RNA; note = Homo sapiens CD47 molecule (CD47), transcript variant X10, misc_RNA, NCBI Reference Sequence: XR_924220.2
gtgcgcgcggccgtgcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggaatgggccagccaactgtgacatcccttggatcggagatttagaactagaaagtattctttctacattattagggaagaaaaggagttacttggcgcttccaatcagaagactatacaacctcctaggaaagctgtagaggaaccccttaatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 18 - RNA, 5136 nt, Homo sapiens
  source 1..5136: mol_type = unassigned RNA; note = Homo sapiens CD47 molecule (CD47), transcript variant X8, misc_RNA, NCBI Reference Sequence: XR_001740374.2
gtgcgcgcggccgtgcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggaatgggccagccaactgtgacatcccttggatcggagatttagaactagaaagtattctttctacattattagggaagaaaaggagttacttggcgcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 19 - RNA, 5194 nt, Homo sapiens
  source 1..5194: mol_type = unassigned RNA; note = Homo sapiens CD47 molecule (CD47), transcript variant X9, misc_RNA, NCBI Reference Sequence: XR_001740375.2
gtgcgcgcggccgtgcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggaatgggccagccaactgtgacatcccttggatcggagatttagaactagaaagtattctttctacattattagggaagaaaaggagttacttggcgcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 20 - RNA, 10546 nt, Homo sapiens
  source 1..10546: mol_type = unassigned RNA; note = Homo sapiens CD47 molecule (CD47), transcript variant X2, misc_RNA, NCBI Reference Sequence: XR_002959610.1
gtgcgcgcggccgtgcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtgggtaagtcaatcttattttcattaacctatgccaataatttcagatatatcacttagaaaatgctttttagtttgttcttccagtttaggaccaaaaatgagaaaatacaattggagtgattcgaggataattaaagagggtagaagacatataggatttttagttggttcttccagtttaagaccagaagtcagaaaatacaattggaatgatttgagggtaattaaagagggtagaagacatataggattaatgaaaatttggtttccaaagtagtttaaaggaaaatggctttatctattagaatgtgtacctttttatactaagtaaaaggggagagatctttgaggatccattttaagtaatagaataggatttttaattgttccagtgtttctgtgatagagctgtcctgcacagacctgtttgtttgtcacttgctctttttcttgcagacatagacaccccagacaggaattaaaattcacaatctatcaattttgttcatttaaagagcagtgacctctaatgcatgactttaaaacagttctagttaaaaccaatataatgaaaacattgagtttcaaaatttaggcttttactccttttaaaatcaattattagtaagtatggaatttacttcattgtttctaacttgtatatttaatctgccaattttcaagtaacatttctgcataaattcttattttttattgagatatatgtacacagagagatattttcaattgtgcctgaaactaatgttatcttacctaagctcaagatgttcccaataatgtaatttatattagtttccgttttttaaaaaaattatatttttatgaaataaaacatactcttaaccacctatcaaaataatcaaaagttataaattaatggagtaaaaaaatagtgtttctgctttgctttaggtaaactttgctgtatgtgtttctaaaacttaatacgaaacttgaattgttatagtcaaataatttctcatatgactcacataatagtttcaaaaaacttttacctttatttctgaactttggttcttgatgattgttaattgaattcaattctgtcatatattctgtgtctttctttaattaatgcttattagataaataattaaaatacttaactaaaatctgcgtatccttagcatatgagttcataagtcttagttgttgctcaatgaaattttctaattttataccacataatgccataaaatacaatggagacatctaaagcagaatggaattcatgtggtagctacagtgaacatcttgaatgttggtgcatattctatttttgttacatcttccaatcaccatgtgtctggttctggaagatgacactcctggttttgttgctccccacaaatgcctgagaatagtgtgtgatttgcagtatccatacaactctggtgaagtagtatgagatacctttggctgacgggcagcacgctcttattttttcctcactatctgggttgtcctcccttttactcccatgccaccccatgccttccatatctagcatagaatgatcttcagtacagttgccagcaggtctggtgacaatgtctcaagtggaactaagcattgtctatctgccacctccttaacttcactctcctgccttctccatcacttacgttcctccaagcctgtgaaaccactgtactgtacctgtcactgttctgacattaaaattaaaatgacttaaatcttgacaagtaccccaaattattttttctttgtcataggttagcatataagtatactatatgctaaaatttatgctatatgtttaaaatttagtgcaattttattgatagtgtcctaattttattgatagtatcctaaattaactttttaaatcaacttgtctgatgccagggttcagagggacacctacagtcagttgaaaggcaagaagagacaaggtacaggaaagttgctctttagataacatggtagactaggaggaacattaatatggtttgcttatataatctgactgtgtaaatctgaatctatgtaacattaaggttgcaaatttgagcgtttatattaggaagttaaaattttaagtgtctccaaaataatttttactcattgcacgtgttctgttttagaaaagcctaatgattgtgttttgatttaaatgcaataaaatcctcaaatagttaaaaatccaagctttctcttcaagaagaagttaatgtcgctatgagatttttaacttttataatttttattatttccaactttaaatttgtagccttaatttgctattttaaagagtaggcctttcactttctacaactttctgtgaaagtgactttcactttctattttttaactttttaaactgtgttgtattttttttcttttattggaagcattttaattttataagatgagaaaaaggactgggcacaataacttaatgtgaaagcatagaaaagattacaagaacctaaccaaactcactaaagttgggcttgttgtttgtagagaacgtttatataattataaggatcaatactttctcatttttaaagccattaccagttagttcaatataagggcatatagtgttttgatacaaatcaatctggtagcagtaagtaccatatttaccacaacatcccagatattttagaatgatgcagatgcagaatatatacgtagaatttatatctatgtatagatacaaattcagatattttcttgttcaatttaaggagaggtaaatttggtatcaatagaaaaaatgtttctgaaaaatttaaaccctggaaatgtatttatggcatggagtcagatgtttcagggagagaagaacaaatcaagaagcattgcaagtatgctcatatggaatgcttaaggcttgtggttaaaaaatatatatatatggctgtcaatgtcttaggctcatggtagcagcagaaatcgtaataattcttttgtcacatgggttatatccatattggagagaattaactcaggtgaaattaacttgtacactgtttggttttataatatttagagggatcacaactgactgatgtccctttgaagtaccattcttcataaatctttttttttcagaatgggccagccaactgtgacatcccttggatcggagatttagaactagaaagtattctttctacattattagggaagaaaaggagttacttggcggttagcaatattctattttgttttgttttgtttttagagacagggtctcattatgttgaccaggctggcctcgagctcctgggctcaagcaatgctcccacctcagcctcccaagtagctgggactacaggcatgtgccactacacctggcagtgtttattctgataaatacatttatgagctcaaaaatgtaactctaaaaccttatctctgaacttccatattaccatcagaaatttagatagttgtttagttctctttttctttgtagaacatagatataaggcatggtttcattgaagtcagttgtatatacatgtaactatcctgatgttcccaaataaagctctgtatttctgcttagtttattggggaggctgctaaatgtagtgcatcccaacccattttaccctgttctactttaaaaagaggttggcttcttgtttggatacaaggaccaagtcactcccccaggttcctccacagtaagggaggcctatttaaagccgcccatggcactaacagaaactggactcctatgagctcagatacataactgggcctcacaggggtgggacagtatgtagtctaggaattggaaggatccattccatatcaaagaactgaagcatcgtgttgccctctcagcagcaagagtaaggtgatgcccctgtcagttatagttcctgagttcctctgtctttgattctttgcctattagccagctagctcaccctcttgtttatgccactgttttttatcctattcatgccttctcacagacaacttttcttacctacagctttggactcatccttgtctcctttctgtttctttttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtgctgtcatccagcccaggtcccagcggaatgggcctctctgttcagtaggatccccctcctgctgagtggttcatggcatgtttctgttcaacgcttttccatctgtaggattcttattctgtatttatttgtttttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccacaggcatgcaccaccacgccagctaatttttgtatttttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 21 - RNA, 8322 nt, Homo sapiens
  source 1..8322: mol_type = unassigned RNA; note = Homo sapiens CD47 molecule (CD47), transcript variant X3, misc_RNA, NCBI Reference Sequence: XR_002959611.1
gtgcgcgcggccgtgcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtgggtaagtcaatcttattttcattaacctatgccaataatttcagatatatcacttagaaaatgctttttagtttgttcttccagtttaggaccaaaaatgagaaaatacaattggagtgattcgaggataattaaagagggtagaagacatataggatttttagttggttcttccagtttaagaccagaagtcagaaaatacaattggaatgatttgagggtaattaaagagggtagaagacatataggattaatgaaaatttggtttccaaagtagtttaaaggaaaatggctttatctattagaatgtgtacctttttatactaagtaaaaggggagagatctttgaggatccattttaagtaatagaataggatttttaattgttccagtgtttctgtgatagagctgtcctgcacagacctgtttgtttgtcacttgctctttttcttgcagacatagacaccccagacaggaattaaaattcacaatctatcaattttgttcatttaaagagcagtgacctctaatgcatgactttaaaacagttctagttaaaaccaatataatgaaaacattgagtttcaaaatttaggcttttactccttttaaaatcaattattagtaagtatggaatttacttcattgtttctaacttgtatatttaatctgccaattttcaagtaacatttctgcataaattcttattttttattgagatatatgtacacagagagatattttcaattgtgcctgaaactaatgttatcttacctaagctcaagatgttcccaataatgtaatttatattagtttccgttttttaaaaaaattatatttttatgaaataaaacatactcttaaccacctatcaaaataatcaaaagttataaattaatggagtaaaaaaatagtgtttctgctttgctttaggtaaactttgctgtatgtgtttctaaaacttaatacgaaacttgaattgttatagtcaaataatttctcatatgactcacataatagtttcaaaaaacttttacctttatttctgaactttggttcttgatgattgttaattgaattcaattctgtcatatattctgtgtctttctttaattaatgcttattagataaataattaaaatacttaactaaaatctgcgtatccttagcatatgagttcataagtcttagttgttgctcaatgaaattttctaattttataccacataatgccataaaatacaatggagacatctaaagcagaatggaattcatgtggtagctacagtgaacatcttgaatgttggtgcatattctatttttgttacatcttccaatcaccatgtgtctggttctggaagatgacactcctggttttgttgctccccacaaatgcctgagaatagtgtgtgatttgcagtatccatacaactctggtgaagtagtatgagatacctttggctgacgggcagcacgctcttattttttcctcactatctgggttgtcctcccttttactcccatgccaccccatgccttccatatctagcatagaatgatcttcagtacagttgccagcaggtctggtgacaatgtctcaagtggaactaagcattgtctatctgccacctccttaacttcactctcctgccttctccatcacttacgttcctccaagcctgtgaaaccactgtactgtacctgtcactgttctgacattaaaattaaaatgacttaaatcttgacaagtaccccaaattattttttctttgtcataggttagcatataagtatactatatgctaaaatttatgctatatgtttaaaatttagtgcaattttattgatagtgtcctaattttattgatagtatcctaaattaactttttaaatcaacttgtctgatgccagggttcagagggacacctacagtcagttgaaaggcaagaagagacaaggtacaggaaagttgctctttagataacatggtagactaggaggaacattaatatggtttgcttatataatctgactgtgtaaatctgaatctatgtaacattaaggttgcaaatttgagcgtttatattaggaagttaaaattttaagtgtctccaaaataatttttactcattgcacgtgttctgttttagaaaagcctaatgattgtgttttgatttaaatgcaataaaatcctcaaatagttaaaaatccaagctttctcttcaagaagaagttaatgtcgctatgagatttttaacttttataatttttattatttccaactttaaatttgtagccttaatttgctattttaaagagtaggcctttcactttctacaactttctgtgaaagtgactttcactttctattttttaactttttaaactgtgttgtattttttttcttttattggaagcattttaattttataagatgagaaaaaggactgggcacaataacttaatgtgaaagcatagaaaagattacaagaacctaaccaaactcactaaagttgggcttgttgtttgtagagaacgtttatataattataaggatcaatactttctcatttttaaagccattaccagttagttcaatataagggcatatagtgttttgatacaaatcaatctggtagcagtaagtaccatatttaccacaacatcccagatattttagaatgatgcagatgcagaatatatacgtagaatttatatctatgtatagatacaaattcagatattttcttgttcaatttaaggagaggtaaatttggtatcaatagaaaaaatgtttctgaaaaatttaaaccctggaaatgtatttatggcatggagtcagatgtttcagggagagaagaacaaatcaagaagcattgcaagtatgctcatatggaatgcttaaggcttgtggttaaaaaatatatatatatggctgtcaatgtcttaggctcatggtagcagcagaaatcgtaataattcttttgtcacatgggttatatccatattggagagaattaactcaggtgaaattaacttgtacactgtttggttttataatatttagagggatcacaactgactgatgtccctttgaagtaccattcttcataaatctttttttttcagaatgggccagccaactgtgacatcccttggatcggagatttagaactagaaagtattctttctacattattagggaagaaaaggagttacttggcgcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 22 - RNA, 5306 nt, Homo sapiens
  source 1..5306: mol_type = unassigned RNA; note = Homo sapiens KRAS proto-oncogene, GTPase (KRAS), transcript variant b, mRNA, NCBI Reference Sequence: NM_004985.5
ctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 23 - RNA, 5430 nt, Homo sapiens
  source 1..5430: mol_type = unassigned RNA; note = Homo sapiens KRAS proto-oncogene, GTPase (KRAS), transcript variant a, mRNA, NCBI Reference Sequence: NM_033360.4
ctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagagagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 24 - RNA, 5417 nt, Homo sapiens
  source 1..5417: mol_type = unassigned RNA; note = Homo sapiens KRAS proto-oncogene, GTPase (KRAS), transcript variant c, mRNA, NCBI Reference Sequence: NM_001369786.1
ctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagagagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 25 - RNA, 5293 nt, Homo sapiens
  source 1..5293: mol_type = unassigned RNA; note = Homo sapiens KRAS proto-oncogene, GTPase (KRAS), transcript variant d, mRNA, NCBI Reference Sequence: NM_001369787.1
ctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 26 - RNA, 5306 nt, Homo sapiens
  source 1..5306: mol_type = unassigned RNA; note = Homo sapiens KRAS proto-oncogene, GTPase (KRAS), KRASG12C variant 1 (Substitution, position 34, G to T)
ctaggcggcggccgcggcggcggaggcagcagctgcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 27 - RNA, 5430 nt, Homo sapiens
  source 1..5430: mol_type = unassigned RNA; note = Homo sapiens KRAS proto-oncogene, GTPase (KRAS), KRASG12C variant 2 (Substitution, position 34, G to T)
ctaggcggcggccgcggcggcggaggcagcagctgcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagagagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 28 - RNA, 5417 nt, Homo sapiens
  source 1..5417: mol_type = unassigned RNA; note = Homo sapiens KRAS proto-oncogene, GTPase (KRAS), KRASG12C variant 3 (Substitution, position 34, G to T)
ctaggcggcggccgcggcggcggaggcagcagctgcggcggcagtggcggcggcgaaggtggcggcggctcggccagtactcccggcccccgccatttcggactgggagcgagcgcggcgcaggcactgaaggcggcggcggggccagaggctcagcggctcccaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagagagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 29 - RNA, 5293 nt, Homo sapiens
  source 1..5293: mol_type = unassigned RNA; note = Homo sapiens KRAS proto-oncogene, GTPase (KRAS), KRASG12C variant 4 (Substitution, position 34, G to T)
ctaggcggcggccgcggcggcggaggcagcagctgcggcggcagtggcggcggcgaaggtggcggcggctcggccagtactcccggcccccgccatttcggactgggagcgagcgcggcgcaggcactgaaggcggcggcggggccagaggctcagcggctcccaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 30 - RNA, 5306 nt, Homo sapiens
  source 1..5306: mol_type = unassigned RNA; note = Homo sapiens KRAS proto-oncogene, GTPase (KRAS), KRASG12D variant 1 (Substitution, position 35, G to A)
ctaggcggcggccgcggcggcggaggcagcagcgacggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 31 - RNA, 5430 nt, Homo sapiens
  source 1..5430: mol_type = unassigned RNA; note = Homo sapiens KRAS proto-oncogene, GTPase (KRAS), KRASG12D variant 2 (Substitution, position 35, G to A)
ctaggcggcggccgcggcggcggaggcagcagcgacggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagagagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 32 - RNA, 5417 nt, Homo sapiens
  source 1..5417: mol_type = unassigned RNA; note = Homo sapiens KRAS proto-oncogene, GTPase (KRAS), KRASG12D variant 3 (Substitution, position 35, G to A)
ctaggcggcggccgcggcggcggaggcagcagcgacggcggcagtggcggcggcgaaggtggcggcggctcggccagtactcccggcccccgccatttcggactgggagcgagcgcggcgcaggcactgaaggcggcggcggggccagaggctcagcggctcccaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagagagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 33 - RNA, 5293 nt, Homo sapiens
  source 1..5293: mol_type = unassigned RNA; note = Homo sapiens KRAS proto-oncogene, GTPase (KRAS), KRASG12D variant 4 (Substitution, position 35, G to A)
ctaggcggcggccgcggcggcggaggcagcagcgacggcggcagtggcggcggcgaaggtggcggcggctcggccagtactcccggcccccgccatttcggactgggagcgagcgcggcgcaggcactgaaggcggcggcggggccagaggctcagcggctcccaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 34 - RNA, 5306 nt, Homo sapiens
  source 1..5306: mol_type = unassigned RNA; note = Homo sapiens KRAS proto-oncogene, GTPase (KRAS), KRASG12V variant 1 (Substitution, position 35, G to T)
ctaggcggcggccgcggcggcggaggcagcagcgtcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 35 - RNA, 5430 nt, Homo sapiens
  source 1..5430: mol_type = unassigned RNA; note = Homo sapiens KRAS proto-oncogene, GTPase (KRAS), KRASG12V variant 2 (Substitution, position 35, G to T)
ctaggcggcggccgcggcggcggaggcagcagcgtcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagagagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 36 - RNA, 5417 nt, Homo sapiens
  source 1..5417: mol_type = unassigned RNA; note = Homo sapiens KRAS proto-oncogene, GTPase (KRAS), KRASG12V variant 3 (Substitution, position 35, G to T)
ctaggcggcggccgcggcggcggaggcagcagcgtcggcggcagtggcggcggcgaaggtggcggcggctcggccagtactcccggcccccgccatttcggactgggagcgagcgcggcgcaggcactgaaggcggcggcggggccagaggctcagcggctcccaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagagagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 37 - RNA, 5293 nt, Homo sapiens
  source 1..5293: mol_type = unassigned RNA; note = Homo sapiens KRAS proto-oncogene, GTPase (KRAS), KRASG12V variant 4 (Substitution, position 35, G to T)
ctaggcggcggccgcggcggcggaggcagcagcgtcggcggcagtggcggcggcgaaggtggcggcggctcggccagtactcccggcccccgccatttcggactgggagcgagcgcggcgcaggcactgaaggcggcggcggggccagaggctcagcggctcccaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 38 - RNA, 3721 nt, Homo sapiens
  source 1..3721: mol_type = unassigned RNA; note = Homo sapiens MYC proto-oncogene, bHLH transcription factor (MYC), transcript variant 1, mRNA, NCBI Reference Sequence: NM_002467.6
aactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaagttgtgaatgttttgtttcgtttcttccccctcccaaccaccaccatccctgtttgttttcatcaattgccccttcagagggtggtcttaagaaaggcaagagttttcctctgttgaaatgggtctgggggccttaaggtctttaagttcttggaggttctaagatgcttcctggagactatgataacagccagagttgacagttagaaggaatggcagaaggcaggtgagaaggtgagaggtaggcaaaggagatacaagaggtcaaaggtagcagttaagtacacaaagaggcataaggactggggagttgggaggaaggtgaggaagaaactcctgttactttagttaaccagtgccagtcccctgctcactccaaacccaggaattctgcccagttgatggggacacggtgggaaccagcttctgctgccttcacaaccaggcgccagtcctgtccatgggttatctcgcaaaccccagaggatctctgggaggaatgctactattaaccctatttcacaaacaaggaaatagaagagctcaaagaggttatgtaacttatctgtagccacgcagataatacaaagcagcaatctggacccattctgttcaaaacacttaacccttcgctatcatgccttggttcatctgggtctaatgtgctgagatcaagaaggtttaggacctaatggacagactcaagtcataacaatgctaagctctatttgtgtcccaagcactcctaagcattttatccctaactctacatcaaccccatgaaggagatactgttgatttccccatattagaagtagagagggaagctgaggcacacaaagactcatccacatgcccaagattcactgatagggaaaagtggaagcgagatttgaacccaggctgtttactcctaacctgtccaagccacctctcagacgacggtaggaatcagctggctgcttgtgagtacaggagttacagtccagtgggttatgttttttaagtctcaacatctaagcctggtcaggcatcagttcccctttttttgtgatttattttgtttttattttgttgttcattgtttaatttttccttttacaatgagaaggtcaccatcttgactcctaccttagccatttgttgaatcagactcatgacggctcctgggaagaagccagttcagatcataaaataaaacatatttattctttgtcatgggagtcattattttagaaactacaaactctccttgcttccatccttttttacatactcatgacacatgctcatcctgagtccttgaaaaggtatttttgaacatgtgtattaattataagcctctgaaaacctatggcccaaaccagaaatgatgttgattatataggtaaatgaaggatgctattgctgttctaattacctcattgtctcagtctcaaagtaggtcttcagctccctgtactttgggattttaatctaccaccacccataaatcaataaataattactttctttga

SEQ ID NO: 39 - RNA, 4515 nt, Homo sapiens
  source 1..4515: mol_type = unassigned RNA; note = Homo sapiens MYC proto-oncogene, bHLH transcription factor (MYC), transcript variant 2, mRNA, NCBI Reference Sequence: NM_001354870.1
ggagtttattcataacgcgctctccaagtatacgtggcaatgcgttgctgggttattttaatcattctaggcatcgttttcctccttatgcctctatcattcctccctatctacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaagttgtgaatgttttgtttcgtttcttccccctcccaaccaccaccatccctgtttgttttcatcaattgccccttcagagggtggtcttaagaaaggcaagagttttcctctgttgaaatgggtctgggggccttaaggtctttaagttcttggaggttctaagatgcttcctggagactatgataacagccagagttgacagttagaaggaatggcagaaggcaggtgagaaggtgagaggtaggcaaaggagatacaagaggtcaaaggtagcagttaagtacacaaagaggcataaggactggggagttgggaggaaggtgaggaagaaactcctgttactttagttaaccagtgccagtcccctgctcactccaaacccaggaattctgcccagttgatggggacacggtgggaaccagcttctgctgccttcacaaccaggcgccagtcctgtccatgggttatctcgcaaaccccagaggatctctgggaggaatgctactattaaccctatttcacaaacaaggaaatagaagagctcaaagaggttatgtaacttatctgtagccacgcagataatacaaagcagcaatctggacccattctgttcaaaacacttaacccttcgctatcatgccttggttcatctgggtctaatgtgctgagatcaagaaggtttaggacctaatggacagactcaagtcataacaatgctaagctctatttgtgtcccaagcactcctaagcattttatccctaactctacatcaaccccatgaaggagatactgttgatttccccatattagaagtagagagggaagctgaggcacacaaagactcatccacatgcccaagattcactgatagggaaaagtggaagcgagatttgaacccaggctgtttactcctaacctgtccaagccacctctcagacgacggtaggaatcagctggctgcttgtgagtacaggagttacagtccagtgggttatgttttttaagtctcaacatctaagcctggtcaggcatcagttcccctttttttgtgatttattttgtttttattttgttgttcattgtttaatttttccttttacaatgagaaggtcaccatcttgactcctaccttagccatttgttgaatcagactcatgacggctcctgggaagaagccagttcagatcataaaataaaacatatttattctttgtcatgggagtcattattttagaaactacaaactctccttgcttccatccttttttacatactcatgacacatgctcatcctgagtccttgaaaaggtatttttgaacatgtgtattaattataagcctctgaaaacctatggcccaaaccagaaatgatgttgattatataggtaaatgaaggatgctattgctgttctaattacctcattgtctcagtctcaaagtaggtcttcagctccctgtactttgggattttaatctaccaccacccataaatcaataaataattactttctttga

SEQ ID NO: 40 - RNA, 3634 nt, Homo sapiens
  source 1..3634: mol_type = unassigned RNA; note = Homo sapiens CD274 molecule (CD274), transcript variant 1, mRNA, NCBI Reference Sequence: NM_014143.4
agttctgcgcagcttcccgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatccca

SEQ ID NO: 41 - RNA, 3292 nt, Homo sapiens
  source 1..3292: mol_type = unassigned RNA; note = Homo sapiens CD274 molecule (CD274), transcript variant 2, mRNA, NCBI Reference Sequence: NM_001267706.2
agttctgcgcagcttcccgaggctccgcaccagccgcgcttctgtccgcctgcagggcattccagaaagatgaggatatttgctgtctttatattcatgacctactggcatttgctgaacgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatccca

SEQ ID NO: 42 - RNA, 868 nt, Homo sapiens
  source 1..868: mol_type = unassigned RNA; note = Homo sapiens CD274 molecule (CD274), transcript variant 4, mRNA, NCBI Reference Sequence: NM_001314029.2
agttctgcgcagcttcccgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcacctagcatgatgtctgcctatcatagtcattcagtgattgttgaataaatgaatgaatgaataaca

SEQ ID NO: 43 - RNA, 3461 nt, Homo sapiens
  source 1..3461: mol_type = unassigned RNA; note = Homo sapiens CD274 molecule (CD274), transcript variant 3, non-coding RNA, NCBI Reference Sequence: NR_052005.2
agttctgcgcagcttcccgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggagattagatcctgaggaaaaccatacagctgaattggtcatcccagaactacctctggcacatcctccaaatgaaaggactcacttgggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatccca

SEQ ID NO: 44 - RNA, 2156 nt, Homo sapiens
  source 1..2156: mol_type = unassigned RNA; note = Homo sapiens CD24 molecule (CD24), transcript variant 7, mRNA, NCBI Reference Sequence: NM_001359084.1
accttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 45 - RNA, 2513 nt, Homo sapiens
  source 1..2513: mol_type = unassigned RNA; note = Homo sapiens CD24 molecule (CD24), transcript variant 1, mRNA, NCBI Reference Sequence: NM_013230.3
gcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 46 - RNA, 2440 nt, Homo sapiens
  source 1..2440: mol_type = unassigned RNA; note = Homo sapiens CD24 molecule (CD24), transcript variant 2, mRNA, NCBI Reference Sequence: NM_001291737.1
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggcttcggggagggcgcggccgcggggccgagcgcgcagatcgctccggacccggacaccgcctgcgaggagcgccgaccagccgggaagggttcgcgctaggcggcgcccgggtcccgtcggccagggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 47 - RNA, 2295 nt, Homo sapiens
  source 1..2295: mol_type = unassigned RNA; note = Homo sapiens CD24 molecule (CD24), transcript variant 3, mRNA, NCBI Reference Sequence: NM_001291738.1
tgctcttgttgcccaggctggaatgcaatggcctgatctctgctcactgcaacctccacctctcaggttcaagctattctcctgcctcagcctcccaagtagctgggattacaggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 48 - RNA, 2374 nt, Homo sapiens
  source 1..2374: mol_type = unassigned RNA; note = Homo sapiens CD24 molecule (CD24), transcript variant 4, mRNA, NCBI Reference Sequence: NM_001291739.1
ctttttaaacaaaccccggttccgggctgaagccgaggcggggaccctctcctgacgctgcgctctctgcgaggcaacctttcacgtccatcgcttgtcatcttaggatccccatgttattttagcccagattggctagttctggggaggcagcatggtgggacgattctgtcccgagtccccgccaggctttgttcgggtcgccgctaccagcgcggtctccctagatcctccatccggggaacctcgccccgggtgcgggtacccggggccgcgcagcgctgcctcgagggtgtatggatgcaccgcgccggcgagagagaccgggggctgggcctgggagaccctagcgggggcgggggcgaagaagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 49 - RNA, 2263 nt, Homo sapiens
  source 1..2263: mol_type = unassigned RNA; note = Homo sapiens CD24 molecule (CD24), transcript variant 5, non-coding RNA, NCBI Reference Sequence: NR_117089.1
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggcttcggggagggcgcggccgcggggccgagcgcgcagatcgctccggacccggacaccgcctgcgaggagcgccgaccagccgggaagggttcgcgctaggcggcgcccgggtcccgtcggccaggatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 50 - RNA, 2336 nt, Homo sapiens
  source 1..2336: mol_type = unassigned RNA; note = Homo sapiens CD24 molecule (CD24), transcript variant 6, non-coding RNA, NCBI Reference Sequence: NR_117090.1
gcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttgggggatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 51 - RNA, 2828 nt, Homo sapiens
  source 1..2828: mol_type = unassigned RNA; note = Homo sapiens CD24 molecule (CD24), transcript variant X1, mRNA, NCBI Reference Sequence: XM_024446293.1
tgcttgaaagttttcacaataagatggataggaaaaaagtattccaccaaaatctaaagagtgatgacgaatctcctctttgtgccggttcattaaattgcctaatggcaactacggataagtaaatgcctttatctcgaacggttctgctctttaaacgaatgacgggcaacagagaccgaaaaagtgtatccccaggaattcgagagggacggtgaattgtagtgggaccgccaggaggggaggttcctgcccccgagtagaacctgggagcagagccgctcggggagggcggtgggggcttcagggccgcggagggggtcccctcagggtgggccgtctcctcctcgcccgccgcaggcaggagcgcgggggaccgaaaccctgtagtttgcagcgtcaggcagcgggtctgcgcccagcgagcggctccccagctcctgggaagatgcggacccgggacgcccccgtgagctcactgcgcctggctgacacgaggcgctcacagaacaaagcaagggcttcggggagggcgcggccgcggggccgagcgcgcagatcgctccggacccggacaccgcctgcgaggagcgccgaccagccgggaagggttcgcgctaggcggcgcccgggtcccgtcggccagggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 52 - RNA, 2574 nt, Homo sapiens
  source 1..2574: mol_type = unassigned RNA; note = Homo sapiens baculoviral IAP repeat containing 5 (BIRC5), transcript variant 1, mRNA, NCBI Reference Sequence: NM_001168.3
gcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatcta

SEQ ID NO: 53 - RNA, 2456 nt, Homo sapiens
  source 1..2456: mol_type = unassigned RNA; note = Homo sapiens baculoviral IAP repeat containing 5 (BIRC5), transcript variant 2, mRNA, NCBI Reference Sequence: NM_001012270.2
gcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatcta

SEQ ID NO: 54 - RNA, 2643 nt, Homo sapiens
  source 1..2643: mol_type = unassigned RNA; note = Homo sapiens baculoviral IAP repeat containing 5 (BIRC5), transcript variant 3, mRNA, NCBI Reference Sequence: NM_001012271.2
gcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccattgggccgggcacggtggcttacgcctgtaataccagcactttgggaggccgaggcgggcggatcacgagagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatcta

SEQ ID NO: 55 - RNA, 2447 nt, Homo sapiens
  source 1..2447: mol_type = unassigned RNA; note = Homo sapiens baculoviral IAP repeat containing 5 (BIRC5), transcript variant X2, misc_RNA, NCBI Reference Sequence: XR_243654.5
aatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgagagagctctgttagcagaatgaaaaaattggaagccagattcagggagggactggaagcaaaagaatttctgttcgaggaagagcctgatgtttgccagggtctgtttaactggacatgaagaggaaggctctggactttcctccaggagtttcaggagaaaggcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttca

SEQ ID NO: 56 - RNA, 2516 nt, Homo sapiens
  source 1..2516: mol_type = unassigned RNA; note = Homo sapiens baculoviral IAP repeat containing 5 (BIRC5), transcript variant X1, misc_RNA, NCBI Reference Sequence: XR_934452.3
aatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccattgggccgggcacggtggcttacgcctgtaataccagcactttgggaggccgaggcgggcggatcacgagagaggaacataaaaagcattcgtccggttgcgctttcctttctgtcaagaagcagtttgaagaattaacccttggtgaatttttgaaactggacagagaaagagccaagaacaaaattgagagagctctgttagcagaatgaaaaaattggaagccagattcagggagggactggaagcaaaagaatttctgttcgaggaagagcctgatgtttgccagggtctgtttaactggacatgaagaggaaggctctggactttcctccaggagtttcaggagaaaggcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttca

SEQ ID NO: 57 - RNA, 3393 nt, Homo sapiens
  source 1..3393: mol_type = unassigned RNA; note = Homo sapiens protein kinase N3 (PKN3), transcript variant 1, mRNA, NCBI Reference Sequence: NM_013355.5
atccctgtccctaactggccggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagagaagggccccaagcggccggagcggcgccatggaggagggggcgccgcggcagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgctgcccccctgcagctccccgagcacaatcagcccccctaaaggatgccctcggaccccaacaacactgcgagaggcctctgaccctgccactcccagtaatttcctgcccaagaagacccccttgggtgaagagatgacacccccacccaagcccccacgcctctacctcccccaggagccaacatccgaggagactccgcgcaccaaacgtccccatatggagcctaggactcgacgtgggccatctccaccagcctcccccaccaggaaaccccctcggcttcaggacttccgctgcttagctgtgctgggccggggacactttgggaaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtg

SEQ ID NO: 58 - RNA, 3349 nt, Homo sapiens
  source 1..3349: mol_type = unassigned RNA; note = Homo sapiens protein kinase N3 (PKN3), transcript variant 2, mRNA, NCBI Reference Sequence: NM_001317926.2
atccctgtccctaactggccggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagagaagggccccaagcggccggagcggcgccatggaggagggggcgccgcggcagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgctgcccccctgcagctccccgagcacaatcagcccccctaaaggatgccctcggaccccaacaacactgcgagaggcctctgaccctgccactcccagtaatttcctgcccaagaagacccccttgggtgaagagatgacacccccacccaagcccccacgcctctacctcccccaggagccaacatccgaggagactccgcgcaccaaacgtccccatatggagcctaggactcgacgtgggccatctccaccagcctcccccaccaggaaaccccctcggcttcaggacttccgctgcttagctgtgctgggccggggacactttgggaaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcagaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtg

SEQ ID NO: 59 - RNA, 3947 nt, Homo sapiens
  source 1..3947: mol_type = unassigned RNA; note = Homo sapiens protein kinase N3 (PKN3), transcript variant X2, mRNA, NCBI Reference Sequence: XM_005251946.3
cagtctccaaatcagtccgcggctgacccggagactgaaccccaaccagcccgtgagcgaggacggctgagtccgcagtgtgcgccaccagggtggtccccagagtgtccttaagtcggttctcctcggtggggctccaaggccgacgggaattagccgggatagaaaggcggggcacaggggcctgggggggttagaatgtgcgcgcagcggggggcgcagtctgtgcgcgcttggcagtggcaggagtccttcccggagcacaggaggcacgaggggagcgtagatgagaggggagcggcctcccccgccccagggcgggaacctttgggtacatagcgggttctagaatgcggagggggctgggtttcctgccagagctggcagtaggtgcgcgtgggcccggaggaccgaggccatgtctatctgctcctgaggagggagaggtggtgtcctgttccggagcgagtggttgggaggggggcatttgcggacaggagtgggtccccgcaaagagcggaaaggaggtggtgtgtgtgtccatgttggagttccaacccagggcagacgggaccatgggggtgttgcggggtgcgtgtagactccttgagcgcccaagccagtcgtttaggccgccttcagggctggggctcggtctgccccctcccacccccttcctctggaggtccctccgcctgttccagacgtagcttgtacacattttccgatttcctgcggggctccgccctgcagcggcagctgggtgactcaggaccccggtggccgggcccccagctccatgggacctttgtttgctccggtctttggctctggccctgtggcctagggcggtcagaggatttcctgagcctcgcccttgccctctgacagctgggccagcaggccccgctgaggtctggggtgggggggtccctgagtctggggttgcggccccttccactgggctcaggagaagatggaacacagagagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgctgcccccctgcagctccccgagcacaatcagcccccctaaaggatgccctcggaccccaacaacactgcgagaggcctctgaccctgccactcccagtaatttcctgcccaagaagacccccttgggtgaagagatgacacccccacccaagcccccacgcctctacctcccccaggagccaacatccgaggagactccgcgcaccaaacgtccccatatggagcctaggactcgacgtgggccatctccaccagcctcccccaccaggaaaccccctcggcttcaggacttccgctgcttagctgtgctgggccggggacactttgggaaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtg

SEQ ID NO: 60 - RNA, 3463 nt, Homo sapiens
  source 1..3463: mol_type = unassigned RNA; note = Homo sapiens protein kinase N3 (PKN3), transcript variant X1, mRNA, NCBI Reference Sequence: XM_006717080.3
cgggcccggggggtgcgagaaagcctctgtcatcgccccggagccccgaaccgcggccgcttcccccgatcctcccctcacccgcgccccttccctgcccctgccctggccccggccccgcgacgccctcgcagagcagacctgatctccgggttcggtggttcctggaccttgcacagtctccaaatcagtccgcggctgacccggagactgaaccccaaccagcccgtgagcgaggacggctgagtccgcagtgtgcgccaccagggtggtccccagagtgtccttaagtcggttctcctcggtggggctccaaggccgacgggaattagccgggatagaaaggcggggcacaggggcctgggggggttagaatgtgcgcgcagcggggggcgcagtctgtgcgcgcttggcagtggcaggagtccttcccggagcacaggaggcacgaggggagcgtagatgagaggggagcggcctcccccgccccagggcgggaacctttggcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgctgcccccctgcagctccccgagcacaatcagcccccctaaaggatgccctcggaccccaacaacactgcgagaggcctctgaccctgccactcccagtaatttcctgcccaagaagacccccttgggtgaagagatgacacccccacccaagcccccacgcctctacctcccccaggagccaacatccgaggagactccgcgcaccaaacgtccccatatggagcctaggactcgacgtgggccatctccaccagcctcccccaccaggaaaccccctcggcttcaggacttccgctgcttagctgtgctgggccggggacactttgggaaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtg

SEQ ID NO: 61 - RNA, 3423 nt, Homo sapiens
  source 1..3423: mol_type = unassigned RNA; note = Homo sapiens protein kinase N3 (PKN3), transcript variant X3, mRNA, NCBI Reference Sequence: XM_017014649.2
cgcgggcccggggggtgcgagaaagcctctgtcatcgccccggagccccgaaccgcggccgcttcccccgatcctcccctcacccgcgccccttccctgcccctgccctggccccggccccgcgacgccctcgcagagcagacctgatctccgggttcggtggttcctggaccttgcacagtctccaaatcagtccgcggctgacccggagactgaaccccaaccagcccgtgagcgaggacggctgagtccgcagtgtgcgccaccagggtggtccccagagtgtccttaagtcggttctcctcggtggggctccaaggccgacgggaattagccgggatagaaaggcggggcacaggggcctgggggggttagaatgtgcgcgcagcggggggcgcagtctgtgcgcgcttggcagtggcaggagtccttcccggagcacaggaggcacgaggggagcgtagatgagaggggagcggcctcccccgccccagggcgggaacctttggcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgctgcccccctgcagctccccgagcacaatcagcccccctaaaggatgccctcggaccccaacaacactgcgagaggcctctgaccctgccactcccagtaatttcctgcccaagaagacccccttgggtgaagagatgacacccccacccaagcccccacgcctctacctcccccaggagccaacatccgaggagactccgcgcaccaaacgtccccatatggagcctaggactcgacgtgggccatctccaccagcctcccccaccaggaaaccccctcggcttcaggacttccgctgcttagctgtgctgggccggggacactttgggaaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcagaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgtg

SEQ ID NO: 62 - RNA, 3601 nt, Homo sapiens
  source 1..3601: mol_type = unassigned RNA; note = Homo sapiens protein kinase N3 (PKN3), transcript variant X4, mRNA, NCBI Reference Sequence: XM_017014650.1
tcccccatccctgtccctaactggccggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagagaagggccccaagcggccggagcggcgccatggaggagggggcgccgcggcaggagcctggcctagatgagtggcctcggagtttccatctggctcaggcctgagctctaaggggagagaggcttccaaaaccctgtgcgagtcagtcctgggtgccgtcccttccttcgcctccatctgcagtgagcaaaggctgctggtggccgctgcaccccatggctgttctccaccctctgctttccaccggctctgcagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgctgcccccctgcagctccccgagcacaatcagcccccctaaaggatgccctcggaccccaacaacactgcgagaggcctctgaccctgccactcccagtaatttcctgcccaagaagacccccttgggtgaagagatgacacccccacccaagcccccacgcctctacctcccccaggagccaacatccgaggagactccgcgcaccaaacgtccccatatggagcctaggactcgacgtgggccatctccaccagcctcccccaccaggaaaccccctcggcttcaggacttccgctgcttagctgtgctgggccggggacactttgggaaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtg

SEQ ID NO: 63 - RNA, 2160 nt, Homo sapiens
  source 1..2160: mol_type = unassigned RNA; note = Homo sapiens polo like kinase 1 (PLK1), mRNA, NCBI Reference Sequence: NM_005030.6
ggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 64 - RNA, 3748 nt, Homo sapiens
  source 1..3748: mol_type = unassigned RNA; note = Homo sapiens fibroblast growth factor 1 (FGF1), transcript variant 1, mRNA, NCBI Reference Sequence: NM_000800.5
agagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 65 - RNA, 3644 nt, Homo sapiens
  source 1..3644: mol_type = unassigned RNA; note = Homo sapiens fibroblast growth factor 1 (FGF1), transcript variant 2, mRNA, NCBI Reference Sequence: NM_033136.4
agagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 66 - RNA, 3616 nt, Homo sapiens
  source 1..3616: mol_type = unassigned RNA; note = Homo sapiens fibroblast growth factor 1 (FGF1), transcript variant 3, mRNA, NCBI Reference Sequence: NM_033137.4
gtgggcataccagtgtcagctgcacttgtaggggcccaagtgcctcatgacccactcggcagccttcctctccaggatccccaaggctaggaggccaacctactaacagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacaacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 67 - RNA, 3652 nt, Homo sapiens
  source 1..3652: mol_type = unassigned RNA; note = Homo sapiens fibroblast growth factor 1 (FGF1), transcript variant 4, mRNA, NCBI Reference Sequence: NM_001144892.3
actgttggcagcagcacaatgtttgggctaagacctggtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 68 - RNA, 3817 nt, Homo sapiens
  source 1..3817: mol_type = unassigned RNA; note = Homo sapiens fibroblast growth factor 1 (FGF1), transcript variant 5, mRNA, NCBI Reference Sequence: NM_001144934.2
gtgggcataccagtgtcagctgcacttgtaggggcccaagtgcctcatgacccactcggcagccttcctctccaggatccccaaggctaggaggccaacctactaacagcagcctgcctgcagctgtcctggtagaacagtgtggacattgcagaagctgtcactgccccagaaagaaagcaccccagagccaaggcaaagagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 69 - RNA, 3723 nt, Homo sapiens
  source 1..3723: mol_type = unassigned RNA; note = Homo sapiens fibroblast growth factor 1 (FGF1), transcript variant 6, mRNA, NCBI Reference Sequence: NM_001144935.2
gtgggcataccagtgtcagctgcacttgtaggggcccaagtgcctcatgacccactcggcagccttcctctccaggatccccaaggctaggaggccaacctactaacagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 70 - RNA, 4072 nt, Homo sapiens
  source 1..4072: mol_type = unassigned RNA; note = Homo sapiens fibroblast growth factor 1 (FGF1), transcript variant 7, mRNA, NCBI Reference Sequence: NM_001257205.1
acatgagagggggagaaataaatatacagtgcttgtccttagcctttctgtgggcataccagtgtcagctgcacttgtaggggcccaagtgcctcatgacccactcggcagccttcctctccaggatccccaaggctaggaggccaacctactaacaggtgggtgggtatggtgtgtggtttcactcagttcttctcatggggtttctctgagctccattcataccagaaagggagcaggagagagaggacaagtggatccaacagccttcgctccaggggaatcagggcatcgcctccttttctgggaggacactcccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtgaaaaaaaaaa

SEQ ID NO: 71 - RNA, 4011 nt, Homo sapiens
  source 1..4011: mol_type = unassigned RNA; note = Homo sapiens fibroblast growth factor 1 (FGF1), transcript variant 8, mRNA, NCBI Reference Sequence: NM_001257206.2
gtgggcataccagtgtcagctgcacttgtaggggcccaagtgcctcatgacccactcggcagccttcctctccaggatccccaaggctaggaggccaacctactaacaggtgggtgggtatggtgtgtggtttcactcagttcttctcatggggtttctctgagctccattcataccagaaagggagcaggagagagaggacaagtggatccaacagccttcgctccaggggaatcagggcatcgcctccttttctgggaggacactcccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcaacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 72 - RNA, 3806 nt, Homo sapiens
  source 1..3806: mol_type = unassigned RNA; note = Homo sapiens fibroblast growth factor 1 (FGF1), transcript variant 9, mRNA, NCBI Reference Sequence: NM_001257207.2
agaagtccattcggctcacacatttgccccaagacaaaccacgttaaaataacacccaggagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 73 - RNA, 3781 nt, Homo sapiens
  source 1..3781: mol_type = unassigned RNA; note = Homo sapiens fibroblast growth factor 1 (FGF1), transcript variant 10, mRNA, NCBI Reference Sequence: NM_001257208.2
agtttagagactgcaaaaatatgaatgcaccatgccgccacattatctccattcctccagtgcccgcctgacactggccctgaatcagggctggagggggcaggcatttctcatttactaaagtgctggatgcagcccttgaggttcggcagaagcagaaagctgcgtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 74 - RNA, 3828 nt, Homo sapiens
  source 1..3828: mol_type = unassigned RNA; note = Homo sapiens fibroblast growth factor 1 (FGF1), transcript variant 11, mRNA, NCBI Reference Sequence: NM_001257209.1
agacatgtaaaaatagtacttctagtttagagactgcaaaaatatgaatgcaccatgccgccacattatctccattcctccagtgcccgcctgacactggccctgaatcagggctggagggggcaggcatttctcatttactaaagtgctggatgcagcccttgaggttcggcagaagcagaaagctgcggtgagtctggctgtgtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtgaaaaaaaaaa

SEQ ID NO: 75 - RNA, 3741 nt, Homo sapiens
  source 1..3741: mol_type = unassigned RNA; note = Homo sapiens fibroblast growth factor 1 (FGF1), transcript variant 12, mRNA, NCBI Reference Sequence: NM_001257210.2
aactcagtgaggcaaccaggcagtggggccggctggccagactcttgggggattccttagtgagtgagttcactgctcaaagaagggctttgccacttctgcagggaagccagccacgggccagcagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 76 - RNA, 3778 nt, Homo sapiens
  source 1..3778: mol_type = unassigned RNA; note = Homo sapiens fibroblast growth factor 1 (FGF1), transcript variant 13, mRNA, NCBI Reference Sequence: NM_001257211.2
agtttagagactgcaaaaatatgaatgcaccatgccgccacattatctccattcctccagtgcccgcctgacactggccctgaatcagggctggagggggcaggcatttctcatttactaaagtgctggatgcagcccttgaggttcggcagaagcagaaagctgcgtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcaacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 77 - RNA, 3649 nt, Homo sapiens
  source 1..3649: mol_type = unassigned RNA; note = Homo sapiens fibroblast growth factor 1 (FGF1), transcript variant 14, mRNA, NCBI Reference Sequence: NM_001257212.2
actgttggcagcagcacaatgtttgggctaagacctggtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcaacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 78 - RNA, 3949 nt, Homo sapiens
  source 1..3949: mol_type = unassigned RNA; note = Homo sapiens fibroblast growth factor 1 (FGF1), transcript variant 15, mRNA, NCBI Reference Sequence: NM_001354951.2
gtgggcataccagtgtcagctgcacttgtaggggcccaagtgcctcatgacccactcggcagccttcctctccaggatccccaaggctaggaggccaacctactaacagcagcctgcctgcagctgtcctggtagaacagtgtggacattgcagaagctgtcactgccccagaaagaaagcaccccagagccaaggcaaagagagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 79 - RNA, 3814 nt, Homo sapiens
  source 1..3814: mol_type = unassigned RNA; note = Homo sapiens fibroblast growth factor 1 (FGF1), transcript variant 16, mRNA, NCBI Reference Sequence: NM_001354952.2
gtgggcataccagtgtcagctgcacttgtaggggcccaagtgcctcatgacccactcggcagccttcctctccaggatccccaaggctaggaggccaacctactaacagcctgcctgcagctgtcctggtagaacagtgtggacattgcagaagctgtcactgccccagaaagaaagcaccccagagccaaggcaaagagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 80 - RNA, 3946 nt, Homo sapiens
  source 1..3946: mol_type = unassigned RNA; note = Homo sapiens fibroblast growth factor 1 (FGF1), transcript variant 17, mRNA, NCBI Reference Sequence: NM_001354953.2
gtgggcataccagtgtcagctgcacttgtaggggcccaagtgcctcatgacccactcggcagccttcctctccaggatccccaaggctaggaggccaacctactaacagcctgcctgcagctgtcctggtagaacagtgtggacattgcagaagctgtcactgccccagaaagaaagcaccccagagccaaggcaaagagagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 81 - RNA, 4144 nt, Homo sapiens
  source 1..4144: mol_type = unassigned RNA; note = Homo sapiens fibroblast growth factor 1 (FGF1), transcript variant 18, mRNA, NCBI Reference Sequence: NM_001354954.2
gtgggcataccagtgtcagctgcacttgtaggggcccaagtgcctcatgacccactcggcagccttcctctccaggatccccaaggctaggaggccaacctactaacaggtgggtgggtatggtgtgtggtttcactcagttcttctcatggggtttctctgagctccattcataccagaaagggagcaggagagagaggacaagtggatccaacagccttcgctccaggggaatcagggcatcgcctccttttctgggaggacactcccttctgatggtgaatgggaactcccttcctcctgcagcagcctgcctgcagctgtcctggtagaacagtgtggacattgcagaagctgtcactgccccagaaagaaagcaccccagagccaaggcaaagaggtgattccagtgcacactcgagcttgagaaccactggtctcggtactgagtatataacagtgagaagacaaagtcctgctctccttgtggaatttgtattccagtgtatgtggtaggggagacagaacaatcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 82 - RNA, 4146 nt, Homo sapiens
  source 1..4146: mol_type = unassigned RNA; note = Homo sapiens fibroblast growth factor 1 (FGF1), transcript variant 19, mRNA, NCBI Reference Sequence: NM_001354955.2
gtgggcataccagtgtcagctgcacttgtaggggcccaagtgcctcatgacccactcggcagccttcctctccaggatccccaaggctaggaggccaacctactaacaggtgggtgggtatggtgtgtggtttcactcagttcttctcatggggtttctctgagctccattcataccagaaagggagcaggagagagaggacaagtggatccaacagccttcgctccaggggaatcagggcatcgcctccttttctgggaggacactcccttctgatggtgaatgggaactcccttcctcctgcagcagcctgcctgcagctgtcctggtagaacagtgtggacattgcagaagctgtcactgccccagaaagaaagcaccccagagccaaggcaaagagagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 83 - RNA, 3900 nt, Homo sapiens
  source 1..3900: mol_type = unassigned RNA; note = Homo sapiens fibroblast growth factor 1 (FGF1), transcript variant 20, mRNA, NCBI Reference Sequence: NM_001354956.2
agtttagagactgcaaaaatatgaatgcaccatgccgccacattatctccattcctccagtgcccgcctgacactggccctgaatcagggctggagggggcaggcatttctcatttactaaagtgctggatgcagcccttgaggttcggcagaagcagaaagctgcgagtttcactcttgttgctcaggctggaatgcaatggcacaatctcggctcactgcaacctccgcctcccgggttcaagcaattctcctgcctcagcctcccaagtagctgggattacagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 84 - RNA, 3941 nt, Homo sapiens
  source 1..3941: mol_type = unassigned RNA; note = Homo sapiens fibroblast growth factor 1 (FGF1), transcript variant 21, mRNA, NCBI Reference Sequence: NM_001354957.2
gtgggcataccagtgtcagctgcacttgtaggggcccaagtgcctcatgacccactcggcagccttcctctccaggatccccaaggctaggaggccaacctactaacagcctgcctgcagctgtcctggtagaacagtgtggacattgcagaagctgtcactgccccagaaagaaagcaccccagagccaaggcaaagaggtgattccagtgcacactcgagcttgagaaccactggtctcggtactgagtatataacagtgagaagacaaagtcctgctctccttgtggaatttgtattccagtgtatgtggtaggggagacagaacaatcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcaacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 85 - RNA, 3814 nt, Homo sapiens
  source 1..3814: mol_type = unassigned RNA; note = Homo sapiens fibroblast growth factor 1 (FGF1), transcript variant 22, mRNA, NCBI Reference Sequence: NM_001354958.2
gtgggcataccagtgtcagctgcacttgtaggggcccaagtgcctcatgacccactcggcagccttcctctccaggatccccaaggctaggaggccaacctactaacagcagcctgcctgcagctgtcctggtagaacagtgtggacattgcagaagctgtcactgccccagaaagaaagcaccccagagccaaggcaaagagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcaacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 86 - RNA, 3910 nt, Homo sapiens
  source 1..3910: mol_type = unassigned RNA; note = Homo sapiens fibroblast growth factor 1 (FGF1), transcript variant 23, mRNA, NCBI Reference Sequence: NM_001354959.2
gtgggcataccagtgtcagctgcacttgtaggggcccaagtgcctcatgacccactcggcagccttcctctccaggatccccaaggctaggaggccaacctactaacaggtgggtgggtatggtgtgtggtttcactcagttcttctcatggggtttctctgagctccattcataccagaaagggagcaggagagagaggacaagtggatccaacagccttcgctccaggggaatcagggcatcgcctccttttctgggaggacactcccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 87 - RNA, 3843 nt, Homo sapiens
  source 1..3843: mol_type = unassigned RNA; note = Homo sapiens fibroblast growth factor 1 (FGF1), transcript variant 24, mRNA, NCBI Reference Sequence: NM_001354961.2
gtgggcataccagtgtcagctgcacttgtaggggcccaagtgcctcatgacccactcggcagccttcctctccaggatccccaaggctaggaggccaacctactaacagcagcctgcctgcagctgtcctggtagaacagtgtggacattgcagaagctgtcactgccccagaaagaaagcaccccagagccaaggcaaagaggtgattccagtgcacactcgagcttgagaaccactggtctcggtactgagtatataacagtgagaagacaaagtcctgctctccttgtggaatttgtattccagtgtatgtggtaggggagacagaacaatcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 88 - RNA, 3619 nt, Homo sapiens
  source 1..3619: mol_type = unassigned RNA; note = Homo sapiens fibroblast growth factor 1 (FGF1), transcript variant 25, mRNA, NCBI Reference Sequence: NM_001354962.2
gtgggcataccagtgtcagctgcacttgtaggggcccaagtgcctcatgacccactcggcagccttcctctccaggatccccaaggctaggaggccaacctactaacagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 89 - RNA, 4040 nt, Homo sapiens
  source 1..4040: mol_type = unassigned RNA; note = Homo sapiens fibroblast growth factor 1 (FGF1), transcript variant 26, mRNA, NCBI Reference Sequence: NM_001354963.2
gtgggcataccagtgtcagctgcacttgtaggggcccaagtgcctcatgacccactcggcagccttcctctccaggatccccaaggctaggaggccaacctactaacaggtgggtgggtatggtgtgtggtttcactcagttcttctcatggggtttctctgagctccattcataccagaaagggagcaggagagagaggacaagtggatccaacagccttcgctccaggggaatcagggcatcgcctccttttctgggaggacactcccttctgatggtgaatgggaactcccttcctcctgcagcagcctgcctgcagctgtcctggtagaacagtgtggacattgcagaagctgtcactgccccagaaagaaagcaccccagagccaaggcaaagaggtgattccagtgcacactcgagcttgagaaccactggtctcggtactgagtatataacagtgagaagacaaagtcctgctctccttgtggaatttgtattccagtgtatgtggtaggggagacagaacaatcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 90 - RNA, 3713 nt, Homo sapiens
  source 1..3713: mol_type = unassigned RNA; note = Homo sapiens fibroblast growth factor 1 (FGF1), transcript variant 27, mRNA, NCBI Reference Sequence: NM_001354964.2
gtgggcataccagtgtcagctgcacttgtaggggcccaagtgcctcatgacccactcggcagccttcctctccaggatccccaaggctaggaggccaacctactaacagcagcctgcctgcagctgtcctggtagaacagtgtggacattgcagaagctgtcactgccccagaaagaaagcaccccagagccaaggcaaagagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 91 - RNA, 6652 nt, Homo sapiens
  source 1..6652: mol_type = unassigned RNA; note = Homo sapiens fibroblast growth factor 2 (FGF2), transcript variant 1, mRNA, NCBI Reference Sequence: NM_001361665.2
gccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagatggaagattactggcttctaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcatttgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcactggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttacactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaatttatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgactacctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctcattttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctccca

SEQ ID NO: 92 - RNA, 6781 nt, Homo sapiens
  source 1..6781: mol_type = unassigned RNA; note = Homo sapiens fibroblast growth factor 2 (FGF2), transcript variant 1, mRNA, NCBI Reference Sequence: NM_002006.5
cggccccagaaaacccgagcgagtagggggcggcgcgcaggagggaggagaactgggggcgcgggaggctggtgggtgtggggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagatggaagattactggcttctaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcatttgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcactggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttacactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaatttatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgactacctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctcattttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctcccaaaaaaa

SEQ ID NO: 93 - RNA, 5313 nt, Homo sapiens
  source 1..5313: mol_type = unassigned RNA; note = Homo sapiens fibroblast growth factor 5 (FGF5), transcript variant 1, mRNA, NCBI Reference Sequence: NM_004464.4
gctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagtgttttggaaatatttgctgtgtctcaggggattgtaggaatacgaggagttttcagcaacaaatttttagcgatgtcaaaaaaaggaaaactccatgcaagtgccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccaatccagtgaatagatgtgcccttttataaggaaacttctgatgtttattaaaaaaactggccttttgatagaggtaacttaatttgggaatttgttgtgttgaaatggcatttaatttcaacctaaatactgactgctggacataaatcacagaaaatttaacttaagaaaatttacaaaatttattctcaggtaatcattttaataaagttctgcaaaatacacgtttatcttacattcagaaatgtggcaaaaaaggcatagctaaaggctaaacatatggctttagtagtaacaaaagggttcatagaaacttcatggtttgcatttaaacatgtttaaagtgtacttataaactatttttttcttaaagcaaactatgatttattttggtgcacaaatacaaagtggaaacttaccaaaattgaactagctaccatataagcagattgctttaatttgatgggaaaatagtacacacatatatataacaaataatatattaaaaaacccatccatcaactaaaacattatatgtatacatcagtatagtgttttattataaagccaattatctgattaagcattctttccactgaatgcataatgtttaaatagcataaaatgaaatgctacaaaaattgaactaatttatactttaaagtatttctgggttaaatgaaacaatgaaattttttagtatgttcaactctcatccaaatggcatatgaccctgtttacacagcctaaagctaaaaatattactctagtttattctaatctattgttaagtattgtgcactgtataccaagttcttagggcacatgaaaaattttagctgccaaacaggaactagtaaacatatgttcctaataagtgaagggaaagataataatgatggtcaacaataagccacgtcaatgcataagttgtataggctaaatgttgcttgtaggctacattaaactcaaatgtaatagtttatcttatactcctggtttgatttgattagcatattaacgtgaaagtaggatagctactaaatatatattatgcaagtcaggaatcattaatttcaaaatttaaagccatgctaaaattaaaaagaaaatattaaattacacaattacacttgtctttactggccatacaaaatgattttttttttttttttgagacagagtcttgctctgtcaccaggctggagtgcagtggcatgatctcggctcactgcaacctccaactccctggtttaagggattctcctgcctcagcctcccaagtagctgggattacagactcatgccaccacgccagctaatttttgtatttttagtagagacggggtttcaccatgttggtcaggatggtctcaatcctggcctcttgatagtcctgacctcatgatctgcccacctcggcctccccaaagtgctgggattacaggtacaatgatgtataattaatgcttagtgaagcataaagttacctacatcaattaattaaatgaacttatgtacagaaaacatgtataaatataagtctatactaatgcttacaactttctaagagggttcttgcttatgtagctttttattattttaagtaactagaaccaccaaatatcaaataaaattatttggttatggttatgttcatctaaacacaacaataacttttatattaatatttaggagtctattttgtctataggtgacaaacatctccagactaacatgtcagttttatcaattatattatgtttaattatttaagatttctttatgtggaacatctatagagataaatagaaattttcaataagatgtagtaacactgtgatttatctttcaagagtctctcttcacttccttctaaagagactaatttgagagtacaggtgcatattaattttcttggttctttcagctgaattatattggtccagaagttcaaaatcatgtgacaataataagggatactgacagaagttatttccaagtttgtgtatatattataaaaattacatatataaaactaaggcttttatttctgttatttttaagcttttatttcttgtagctaaaaataaaacatcataaatctggtaggtaaatttcttattaaatcaatcttgaaatagaaaatgtaataactttcttaccattaacattttttacccttccatagaagggagggaataaatcatgacttatcccattttcaataacaaaacgaaactatggcactaaccaaaaacttgcattctggcataatttttacagttgcagagaattgtttctgggctcattaaaaaaagtagtattgcagacattgctgcaatgggaagcagacaataacttcttaaaggaattctacacctcctttaagatttacttaattgctacatctaaattctgataatttaaaatccattttaggtgataaaattttttaaaagttttgaaggaaacctctggataaatggacaaggcctaatttttttttgtagtcaatccaactgtactggccaatttttgaaataagattatatgattaggtattagcagagacaaagagttacctcctccatcttactctgccctatttgaaagtctcaggggagaaaagggaacaagatgctgatccaacctgagtggagtcaggtgaggcatctttacatctaagaatttttttttaaattttattattattatacttcaagttctagggtacatgtccacaatgcacatgtctgtcacacatgcacacatgtgccatgctggtgtgctgcacccaccaacctgtcatccagcattaggtatatctcctaatgctatccctcccctctccacccaccccacagcaggccccggtatgtgatgttccccttcgtgtgtccatgtgttcttattgttcaattcccacctatgagtgagaatatgtggtgtttggtttttggtccttgcaatagtttgctgagaatgatggtttccagcttcatccatgtccctacaaagaacatgaactcatcattttttatggctgcatagtattccatggtgtatatgtgccacattttcttaatccagtctatcattgttggacatttgggttggttccaagtctttgctattgtgaatagtgctgcaataaacatatgtgtgcatgtgtcttta

SEQ ID NO: 94 - RNA, 5295 nt, Homo sapiens
  source 1..5295: mol_type = unassigned RNA; note = Homo sapiens fibroblast growth factor 5 (FGF5), transcript variant 2, mRNA, NCBI Reference Sequence: NM_033143.2
ggggaagcttcgcaggcgtgcacggagcagtgagatcactggcgttataaatatcccggtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccaatccagtgaatagatgtgcccttttataaggaaacttctgatgtttattaaaaaaactggccttttgatagaggtaacttaatttgggaatttgttgtgttgaaatggcatttaatttcaacctaaatactgactgctggacataaatcacagaaaatttaacttaagaaaatttacaaaatttattctcaggtaatcattttaataaagttctgcaaaatacacgtttatcttacattcagaaatgtggcaaaaaaggcatagctaaaggctaaacatatggctttagtagtaacaaaagggttcatagaaacttcatggtttgcatttaaacatgtttaaagtgtacttataaactatttttttcttaaagcaaactatgatttattttggtgcacaaatacaaagtggaaacttaccaaaattgaactagctaccatataagcagattgctttaatttgatgggaaaatagtacacacatatatataacaaataatatattaaaaaacccatccatcaactaaaacattatatgtatacatcagtatagtgttttattataaagccaattatctgattaagcattctttccactgaatgcataatgtttaaatagcataaaatgaaatgctacaaaaattgaactaatttatactttaaagtatttctgggttaaatgaaacaatgaaattttttagtatgttcaactctcatccaaatggcatatgaccctgtttacacagcctaaagctaaaaatattactctagtttattctaatctattgttaagtattgtgcactgtataccaagttcttagggcacatgaaaaattttagctgccaaacaggaactagtaaacatatgttcctaataagtgaagggaaagataataatgatggtcaacaataagccacgtcaatgcataagttgtataggctaaatgttgcttgtaggctacattaaactcaaatgtaatagtttatcttatactcctggtttgatttgattagcatattaacgtgaaagtaggatagctactaaatatatattatgcaagtcaggaatcattaatttcaaaatttaaagccatgctaaaattaaaaagaaaatattaaattacacaattacacttgtctttactggccatacaaaatgattttttttttttttttgagacagagtcttgctctgtcaccaggctggagtgcagtggcatgatctcggctcactgcaacctccaactccctggtttaagggattctcctgcctcagcctcccaagtagctgggattacagactcatgccaccacgccagctaatttttgtatttttagtagagacggggtttcaccatgttggtcaggatggtctcaatcctggcctcttgatagtcctgacctcatgatctgcccacctcggcctccccaaagtgctgggattacaggtacaatgatgtataattaatgcttagtgaagcataaagttacctacatcaattaattaaatgaacttatgtacagaaaacatgtataaatataagtctatactaatgcttacaactttctaagagggttcttgcttatgtagctttttattattttaagtaactagaaccaccaaatatcaaataaaattatttggttatggttatgttcatctaaacacaacaataacttttatattaatatttaggagtctattttgtctataggtgacaaacatctccagactaacatgtcagttttatcaattatattatgtttaattatttaagatttctttatgtggaacatctatagagataaatagaaattttcaataagatgtagtaacactgtgatttatctttcaagagtctctcttcacttccttctaaagagactaatttgagagtacaggtgcatattaattttcttggttctttcagctgaattatattggtccagaagttcaaaatcatgtgacaataataagggatactgacagaagttatttccaagtttgtgtatatattataaaaattacatatataaaactaaggcttttatttctgttatttttaagcttttatttcttgtagctaaaaataaaacatcataaatctggtaggtaaatttcttattaaatcaatcttgaaatagaaaatgtaataactttcttaccattaacattttttacccttccatagaagggagggaataaatcatgacttatcccattttcaataacaaaacgaaactatggcactaaccaaaaacttgcattctggcataatttttacagttgcagagaattgtttctgggctcattaaaaaaagtagtattgcagacattgctgcaatgggaagcagacaataacttcttaaaggaattctacacctcctttaagatttacttaattgctacatctaaattctgataatttaaaatccattttaggtgataaaattttttaaaagttttgaaggaaacctctggataaatggacaaggcctaatttttttttgtagtcaatccaactgtactggccaatttttgaaataagattatatgattaggtattagcagagacaaagagttacctcctccatcttactctgccctatttgaaagtctcaggggagaaaagggaacaagatgctgatccaacctgagtggagtcaggtgaggcatctttacatctaagaatttttttttaaattttattattattatacttcaagttctagggtacatgtccacaatgcacatgtctgtcacacatgcacacatgtgccatgctggtgtgctgcacccaccaacctgtcatccagcattaggtatatctcctaatgctatccctcccctctccacccaccccacagcaggccccggtatgtgatgttccccttcgtgtgtccatgtgttcttattgttcaattcccacctatgagtgagaatatgtggtgtttggtttttggtccttgcaatagtttgctgagaatgatggtttccagcttcatccatgtccctacaaagaacatgaactcatcattttttatggctgcatagtattccatggtgtatatgtgccacattttcttaatccagtctatcattgttggacatttgggttggttccaagtctttgctattgtgaatagtgctgcaataaacatatgtgtgcatgtgtctttaaaaaaaaaaa

SEQ ID NO: 95 - RNA, 5098 nt, Homo sapiens
  source 1..5098: mol_type = unassigned RNA; note = Homo sapiens fibroblast growth factor 5 (FGF5), transcript variant 3, mRNA, NCBI Reference Sequence: NM_001291812.2
agtagggccagatcgctcttccagcgcgggttggtccaccaggcagagccccagccagggcctgtcaggtacccagggagaccggaaatgtagccaggagacagcagcgctcacagtcacctggtttcagtgtcagcctggttgctcctagatgttcctaacttgctccatctcagaccaaagactccacgggccattgggctccttcttacacaggctccagaggagcgtggacaccaccggcggtctgaagatttggcagccagcagtctccagaggggggtcggaggcgcgcaagtgggtgttttggaaatatttgctgtgtctcaggggattgtaggaatacgaggagttttcagcaacaaatttttagcgatgtcaaaaaaaggaaaactccatgcaagtgccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccaatccagtgaatagatgtgcccttttataaggaaacttctgatgtttattaaaaaaactggccttttgatagaggtaacttaatttgggaatttgttgtgttgaaatggcatttaatttcaacctaaatactgactgctggacataaatcacagaaaatttaacttaagaaaatttacaaaatttattctcaggtaatcattttaataaagttctgcaaaatacacgtttatcttacattcagaaatgtggcaaaaaaggcatagctaaaggctaaacatatggctttagtagtaacaaaagggttcatagaaacttcatggtttgcatttaaacatgtttaaagtgtacttataaactatttttttcttaaagcaaactatgatttattttggtgcacaaatacaaagtggaaacttaccaaaattgaactagctaccatataagcagattgctttaatttgatgggaaaatagtacacacatatatataacaaataatatattaaaaaacccatccatcaactaaaacattatatgtatacatcagtatagtgttttattataaagccaattatctgattaagcattctttccactgaatgcataatgtttaaatagcataaaatgaaatgctacaaaaattgaactaatttatactttaaagtatttctgggttaaatgaaacaatgaaattttttagtatgttcaactctcatccaaatggcatatgaccctgtttacacagcctaaagctaaaaatattactctagtttattctaatctattgttaagtattgtgcactgtataccaagttcttagggcacatgaaaaattttagctgccaaacaggaactagtaaacatatgttcctaataagtgaagggaaagataataatgatggtcaacaataagccacgtcaatgcataagttgtataggctaaatgttgcttgtaggctacattaaactcaaatgtaatagtttatcttatactcctggtttgatttgattagcatattaacgtgaaagtaggatagctactaaatatatattatgcaagtcaggaatcattaatttcaaaatttaaagccatgctaaaattaaaaagaaaatattaaattacacaattacacttgtctttactggccatacaaaatgattttttttttttttttgagacagagtcttgctctgtcaccaggctggagtgcagtggcatgatctcggctcactgcaacctccaactccctggtttaagggattctcctgcctcagcctcccaagtagctgggattacagactcatgccaccacgccagctaatttttgtatttttagtagagacggggtttcaccatgttggtcaggatggtctcaatcctggcctcttgatagtcctgacctcatgatctgcccacctcggcctccccaaagtgctgggattacaggtacaatgatgtataattaatgcttagtgaagcataaagttacctacatcaattaattaaatgaacttatgtacagaaaacatgtataaatataagtctatactaatgcttacaactttctaagagggttcttgcttatgtagctttttattattttaagtaactagaaccaccaaatatcaaataaaattatttggttatggttatgttcatctaaacacaacaataacttttatattaatatttaggagtctattttgtctataggtgacaaacatctccagactaacatgtcagttttatcaattatattatgtttaattatttaagatttctttatgtggaacatctatagagataaatagaaattttcaataagatgtagtaacactgtgatttatctttcaagagtctctcttcacttccttctaaagagactaatttgagagtacaggtgcatattaattttcttggttctttcagctgaattatattggtccagaagttcaaaatcatgtgacaataataagggatactgacagaagttatttccaagtttgtgtatatattataaaaattacatatataaaactaaggcttttatttctgttatttttaagcttttatttcttgtagctaaaaataaaacatcataaatctggtaggtaaatttcttattaaatcaatcttgaaatagaaaatgtaataactttcttaccattaacattttttacccttccatagaagggagggaataaatcatgacttatcccattttcaataacaaaacgaaactatggcactaaccaaaaacttgcattctggcataatttttacagttgcagagaattgtttctgggctcattaaaaaaagtagtattgcagacattgctgcaatgggaagcagacaataacttcttaaaggaattctacacctcctttaagatttacttaattgctacatctaaattctgataatttaaaatccattttaggtgataaaattttttaaaagttttgaaggaaacctctggataaatggacaaggcctaatttttttttgtagtcaatccaactgtactggccaatttttgaaataagattatatgattaggtattagcagagacaaagagttacctcctccatcttactctgccctatttgaaagtctcaggggagaaaagggaacaagatgctgatccaacctgagtggagtcaggtgaggcatctttacatctaagaatttttttttaaattttattattattatacttcaagttctagggtacatgtccacaatgcacatgtctgtcacacatgcacacatgtgccatgctggtgtgctgcacccaccaacctgtcatccagcattaggtatatctcctaatgctatccctcccctctccacccaccccacagcaggccccggtatgtgatgttccccttcgtgtgtccatgtgttcttattgttcaattcccacctatgagtgagaatatgtggtgtttggtttttggtccttgcaatagtttgctgagaatgatggtttccagcttcatccatgtccctacaaagaacatgaactcatcattttttatggctgcatagtattccatggtgtatatgtgccacattttcttaatccagtctatcattgttggacatttgggttggttccaagtctttgctattgtgaatagtgctgcaataaacatatgtgtgcatgtgtcttta

SEQ ID NO: 96 - RNA, 9905 nt, Homo sapiens
  source 1..9905: mol_type = unassigned RNA; note = Homo sapiens epidermal growth factor receptor (EGFR), transcript variant 1, mRNA, NCBI Reference Sequence: NM_005228.5
agacgtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttcttcatattttaattttccaccataaagtttagttgctaaattctattaattttaagattgtgcttcccaaaatagttctcacttcatctgtccagggaggcacagttctgtctggtagaagccgcaaagcccttagcctcttcacggatctggcgactgtgatgggcaggtcaggagaggagctgcccaaagtcccatgattttcacctaacagccctgatcagtcagtactcaaagcttggactccatccctgaaggtcttcctgattgatagcctggccttaataccctacagaaagcctgtccattggctgtttcttcctcagtcagttcctggaagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcctgagtaccttataataataataatgtattctttgttaacaa

SEQ ID NO: 97 - RNA, 2254 nt, Homo sapiens
  source 1..2254: mol_type = unassigned RNA; note = Homo sapiens epidermal growth factor receptor (EGFR), transcript variant 2, mRNA, NCBI Reference Sequence: NM_201282.2
agacgtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggtcctaataaatcttcactgtctgactttagtctcccactaaaactgcatttcctttctacaatttcaatttctccctttgcttcaaataaagtcctgacactattcatttga

SEQ ID NO: 98 - RNA, 1575 nt, Homo sapiens
  source 1..1575: mol_type = unassigned RNA; note = Homo sapiens epidermal growth factor receptor (EGFR), transcript variant 3, mRNA, NCBI Reference Sequence: NM_201283.2
agacgtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaa

SEQ ID NO: 99 - RNA, 2872 nt, Homo sapiens
  source 1..2872: mol_type = unassigned RNA; note = Homo sapiens epidermal growth factor receptor (EGFR), transcript variant 4, mRNA, NCBI Reference Sequence: NM_201284.2
agacgtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccactgagcctcatgccttcacgtgtctgttccccccgcttttcctttctgccacccctgcacgtgggccgccaggttcccaagagtatcctacccatttccttccttccactccctttgccagtgcctctcaccccaactagtagctaaccatcacccccaggactgacctcttcctcctcgctgccagatgattgttcaaagcacagaatttgtcagaaacctgcagggactccatgctgccagccttctccgtaattagcatggccccagtccatgcttctagccttggttccttctgcccctctgtttgaaattctagagccagctgtgggacaattatctgtgtcaaaagccagatgtgaaaacatctcaataacaaactggctgctttgttcaatgctagaacaacgcctgtcacagagtagaaactcaaaaatatttgctgagtgaatgaacaaatgaataaatgcataataaataattaaccaccaatccaa

SEQ ID NO: 100 - RNA, 3848 nt, Homo sapiens
  source 1..3848: mol_type = unassigned RNA; note = Homo sapiens epidermal growth factor receptor (EGFR), transcript variant 5, mRNA, NCBI Reference Sequence: NM_001346897.2
agacgtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccaga

SEQ ID NO: 101 - RNA, 3983 nt, Homo sapiens
  source 1..3983: mol_type = unassigned RNA; note = Homo sapiens epidermal growth factor receptor (EGFR), transcript variant 6, mRNA, NCBI Reference Sequence: NM_001346898.2
agacgtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccaga

SEQ ID NO: 102 - RNA, 9770 nt, Homo sapiens
  source 1..9770: mol_type = unassigned RNA; note = Homo sapiens epidermal growth factor receptor (EGFR), transcript variant 7, mRNA, NCBI Reference Sequence: NM_001346899.2
agacgtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttcttcatattttaattttccaccataaagtttagttgctaaattctattaattttaagattgtgcttcccaaaatagttctcacttcatctgtccagggaggcacagttctgtctggtagaagccgcaaagcccttagcctcttcacggatctggcgactgtgatgggcaggtcaggagaggagctgcccaaagtcccatgattttcacctaacagccctgatcagtcagtactcaaagcttggactccatccctgaaggtcttcctgattgatagcctggccttaataccctacagaaagcctgtccattggctgtttcttcctcagtcagttcctggaagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcctgagtaccttataataataataatgtattctttgttaacaa

SEQ ID NO: 103 - RNA, 9676 nt, Homo sapiens
  source 1..9676: mol_type = unassigned RNA; note = Homo sapiens epidermal growth factor receptor (EGFR), transcript variant 8, mRNA, NCBI Reference Sequence: NM_001346900.2
agttctccactggacttcagaacaagagggagctctgggctgctggctggttgtgcatttgctgtgggttccctccggcaggcgacctctccgcgctgagaaggttatccggataaccaatttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttcttcatattttaattttccaccataaagtttagttgctaaattctattaattttaagattgtgcttcccaaaatagttctcacttcatctgtccagggaggcacagttctgtctggtagaagccgcaaagcccttagcctcttcacggatctggcgactgtgatgggcaggtcaggagaggagctgcccaaagtcccatgattttcacctaacagccctgatcagtcagtactcaaagcttggactccatccctgaaggtcttcctgattgatagcctggccttaataccctacagaaagcctgtccattggctgtttcttcctcagtcagttcctggaagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcctgagtaccttataataataataatgtattctttgttaacaa

SEQ ID NO: 104 - RNA, 9104 nt, Homo sapiens
  source 1..9104: mol_type = unassigned RNA; note = Homo sapiens epidermal growth factor receptor (EGFR), transcript variant EGFRvIII, mRNA, NCBI Reference Sequence: NM_001346941.2
agacgtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaaggtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttcttcatattttaattttccaccataaagtttagttgctaaattctattaattttaagattgtgcttcccaaaatagttctcacttcatctgtccagggaggcacagttctgtctggtagaagccgcaaagcccttagcctcttcacggatctggcgactgtgatgggcaggtcaggagaggagctgcccaaagtcccatgattttcacctaacagccctgatcagtcagtactcaaagcttggactccatccctgaaggtcttcctgattgatagcctggccttaataccctacagaaagcctgtccattggctgtttcttcctcagtcagttcctggaagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcctgagtaccttataataataataatgtattctttgttaacaa

SEQ ID NO: 105 - RNA, 3609 nt, Homo sapiens
  source 1..3609: mol_type = unassigned RNA; note = Homo sapiens vascular endothelial growth factor A (VEGFA), transcript variant 2, mRNA, NCBI Reference Sequence: NM_003376.6
gcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 106 - RNA, 3660 nt, Homo sapiens
  source 1..3660: mol_type = unassigned RNA; note = Homo sapiens vascular endothelial growth factor A (VEGFA), transcript variant 1, mRNA, NCBI Reference Sequence: NM_001025366.3
gcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 107 - RNA, 3591 nt, Homo sapiens
  source 1..3591: mol_type = unassigned RNA; note = Homo sapiens vascular endothelial growth factor A (VEGFA), transcript variant 3, mRNA, NCBI Reference Sequence: NM_001025367.3
gcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccgtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 108 - RNA, 3537 nt, Homo sapiens
  source 1..3537: mol_type = unassigned RNA; note = Homo sapiens vascular endothelial growth factor A (VEGFA), transcript variant 4, mRNA, NCBI Reference Sequence: NM_001025368.3
gcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 109 - RNA, 3502 nt, Homo sapiens
  source 1..3502: mol_type = unassigned RNA; note = Homo sapiens vascular endothelial growth factor A (VEGFA), transcript variant 5, mRNA, NCBI Reference Sequence: NM_001025369.3
gcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 110 - RNA, 3405 nt, Homo sapiens
  source 1..3405: mol_type = unassigned RNA; note = Homo sapiens vascular endothelial growth factor A (VEGFA), transcript variant 6, mRNA, NCBI Reference Sequence: NM_001025370.3
gcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 111 - RNA, 3471 nt, Homo sapiens
  source 1..3471: mol_type = unassigned RNA; note = Homo sapiens vascular endothelial growth factor A (VEGFA), transcript variant 7, mRNA, NCBI Reference Sequence: NM_001033756.3
gcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 112 - RNA, 3375 nt, Homo sapiens
  source 1..3375: mol_type = unassigned RNA; note = Homo sapiens vascular endothelial growth factor A (VEGFA), transcript variant 8, mRNA, NCBI Reference Sequence: NM_001171622.2
gcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 113 - RNA, 3660 nt, Homo sapiens; identical to SEQ ID NO: 106
  source 1..3660: mol_type = unassigned RNA; note = Homo sapiens vascular endothelial growth factor A (VEGFA), transcript variant 1, mRNA, NCBI Reference Sequence: NM_001171623.2

SEQ ID NO: 114 - RNA, 3609 nt, Homo sapiens; identical to SEQ ID NO: 105
  source 1..3609: mol_type = unassigned RNA; note = Homo sapiens vascular endothelial growth factor A (VEGFA), transcript variant 2, mRNA, NCBI Reference Sequence: NM_001171624.2

SEQ ID NO: 115 - RNA, 3591 nt, Homo sapiens; identical to SEQ ID NO: 107
  source 1..3591: mol_type = unassigned RNA; note = Homo sapiens vascular endothelial growth factor A (VEGFA), transcript variant 3, mRNA, NCBI Reference Sequence: NM_001171625.2

SEQ ID NO: 116 - RNA, 3537 nt, Homo sapiens; identical to SEQ ID NO: 108
  source 1..3537: mol_type = unassigned RNA; note = Homo sapiens vascular endothelial growth factor A (VEGFA), transcript variant 4, mRNA, NCBI Reference Sequence: NM_001171626.2

SEQ ID NO: 117 - RNA, 3502 nt, Homo sapiens; identical to SEQ ID NO: 109
  source 1..3502: mol_type = unassigned RNA; note = Homo sapiens vascular endothelial growth factor A (VEGFA), transcript variant 5, mRNA, NCBI Reference Sequence: NM_001171627.2

SEQ ID NO: 118 - RNA, 3405 nt, Homo sapiens; identical to SEQ ID NO: 110
  source 1..3405: mol_type = unassigned RNA; note = Homo sapiens vascular endothelial growth factor A (VEGFA), transcript variant 6, mRNA, NCBI Reference Sequence: NM_001171628.2

SEQ ID NO: 119 - RNA, 3471 nt, Homo sapiens; identical to SEQ ID NO: 111
  source 1..3471: mol_type = unassigned RNA; note = Homo sapiens vascular endothelial growth factor A (VEGFA), transcript variant 7, mRNA, NCBI Reference Sequence: NM_001171629.2

SEQ ID NO: 120 - RNA, 3375 nt, Homo sapiens; identical to SEQ ID NO: 112
  source 1..3375: mol_type = unassigned RNA; note = Homo sapiens vascular endothelial growth factor A (VEGFA), transcript variant 8, mRNA, NCBI Reference Sequence: NM_001171630.2

SEQ ID NO: 121 - RNA, 3477 nt, Homo sapiens
  source 1..3477: mol_type = unassigned RNA; note = Homo sapiens vascular endothelial growth factor A (VEGFA), transcript variant 9, mRNA, NCBI Reference Sequence: NM_001204384.2
gcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 122 - RNA, 3477 nt, Homo sapiens; identical to SEQ ID NO: 121
  source 1..3477: mol_type = unassigned RNA; note = Homo sapiens vascular endothelial growth factor A (VEGFA), transcript variant 9, mRNA, NCBI Reference Sequence: NM_001204385.2

SEQ ID NO: 123 - RNA, 2569 nt, Homo sapiens
  source 1..2569: mol_type = unassigned RNA; note = Homo sapiens vascular endothelial growth factor A (VEGFA), transcript variant 10, mRNA, NCBI Reference Sequence: NM_001287044.2
gcggagccgattacatcagcccgggcctggccggccgcgtgttcccggagcctcggctgcccgaatggggagcccagagtggcgagcggcacccctccccccgccagccctccgcgggaaggtgacctctcgagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaa

SEQ ID NO: 124 - RNA, 3554 nt, Homo sapiens
  source 1..3554: mol_type = unassigned RNA; note = Homo sapiens vascular endothelial growth factor A (VEGFA), transcript variant 4, mRNA, NCBI Reference Sequence: NM_001317010.1
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 125 - RNA, 1805 nt, Homo sapiens
  source 1..1805: mol_type = unassigned RNA; note = Homo sapiens vascular endothelial growth factor B (VEGFB), transcript variant VEGFB-186, mRNA, NCBI Reference Sequence: NM_003377.5
gccgtccccgccgccgctgcccgccgccaccggccgcccgcccgcccggctcctccggccgcctccgctgcgctgcgctgcgctgcctgcacccagggctcgggagggggccgcggaggagtcgccccccgcgcccggcccccgcccgccgcgcccgggcccgcgccatggggctctggctgtcgccgccccccgcgccgccgggctagggcgatgcgggcgcccccggcgggcggccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaaggagctgtccctgcctgtgtcactgtttgtcactgtccaggctggctggtttgggcatgaatgtctgcatcactaaatccagagcttgtcttgctccctcattgtgcagatggaggaaatgaggactaaggccccacagcagatcccaggcagggccagaattatgtattcatcactttcaagttattgccacgcatgggagtcagggatagcccagtcaatacagactgcctgccctcctgctcttcaccagggttcttttctagaaggagacagccttctgtggccagagagcttggggtaggacccagatctactgagtgaccttgcttgtcactacccctgcctctctgagcagcagtttccacatgtgcacatagagggaacagaagattgctgtggttggcgtcctcgggccccagagaagtttgagactatctttacgtaatagaaaagaacacttgttcttcctgccaggca

SEQ ID NO: 126 - RNA, 1704 nt, Homo sapiens
  source 1..1704: mol_type = unassigned RNA; note = Homo sapiens vascular endothelial growth factor B (VEGFB), transcript variant VEGFB-167, mRNA, NCBI Reference Sequence: NM_001243733.2
gccgtccccgccgccgctgcccgccgccaccggccgcccgcccgcccggctcctccggccgcctccgctgcgctgcgctgcgctgcctgcacccagggctcgggagggggccgcggaggagtcgccccccgcgcccggcccccgcccgccgcgcccgggcccgcgccatggggctctggctgtcgccgccccccgcgccgccgggctagggcgatgcgggcgcccccggcgggcggccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaaggagctgtccctgcctgtgtcactgtttgtcactgtccaggctggctggtttgggcatgaatgtctgcatcactaaatccagagcttgtcttgctccctcattgtgcagatggaggaaatgaggactaaggccccacagcagatcccaggcagggccagaattatgtattcatcactttcaagttattgccacgcatgggagtcagggatagcccagtcaatacagactgcctgccctcctgctcttcaccagggttcttttctagaaggagacagccttctgtggccagagagcttggggtaggacccagatctactgagtgaccttgcttgtcactacccctgcctctctgagcagcagtttccacatgtgcacatagagggaacagaagattgctgtggttggcgtcctcgggccccagagaagtttgagactatctttacgtaatagaaaagaacacttgttcttcctgccaggca

SEQ ID NO: 127 - RNA, 5833 nt, Homo sapiens
  source 1..5833: mol_type = unassigned RNA; note = Homo sapiens kinase insert domain receptor (KDR), mRNA, NCBI Reference Sequence: NM_002253.4
actgagtcccgggaccccgggagagcggtcaatgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaagctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacacccccaactcctggacatcacatgagaggtgctgctcagattttcaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctctttttcattcatttaaaaagcatttatcatgccccctgctgcgggtctcaccatgggtttagaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttgaa

SEQ ID NO: 128 - RNA, 4557 nt, Homo sapiens
  source 1..4557: mol_type = unassigned RNA; note = Homo sapiens erb-b2 receptor tyrosine kinase 2 (ERBB2), transcript variant 1, mRNA, NCBI Reference Sequence: NM_004448.4
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 129 - RNA, 4858 nt, Homo sapiens
  source 1..4858: mol_type = unassigned RNA; note = Homo sapiens erb-b2 receptor tyrosine kinase 2 (ERBB2), transcript variant 2, mRNA, NCBI Reference Sequence: NM_001005862.3
gttctttattctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 130 - RNA, 4909 nt, Homo sapiens
  source 1..4909: mol_type = unassigned RNA; note = Homo sapiens erb-b2 receptor tyrosine kinase 2 (ERBB2), transcript variant 3, mRNA, NCBI Reference Sequence: NM_001289936.2
gttctttattctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagatacttcaaagattccagaagatatgccccgggggtcctggaagccacaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 131 - RNA, 4304 nt, Homo sapiens
  source 1..4304: mol_type = unassigned RNA; note = Homo sapiens erb-b2 receptor tyrosine kinase 2 (ERBB2), transcript variant 4, mRNA, NCBI Reference Sequence: NM_001289937.2
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 132 - RNA, 2551 nt, Homo sapiens
  source 1..2551: mol_type = unassigned RNA; note = Homo sapiens erb-b2 receptor tyrosine kinase 2 (ERBB2), transcript variant 5, mRNA, NCBI Reference Sequence: NM_001289938.2
gttctttattctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcgtgagtccaacggtcttttctgcagaaaggaggactttcctttcaggggtctttctggggctcttactataaaaggggaccaactctccctttgtcatatcttgtttctgatgacaaaaataacacattgttaaaattgtaaaattaaaacatgaaatataaattaatgccctagca

SEQ ID NO: 133 - RNA, 5165 nt, Homo sapiens
  source 1..5165: mol_type = unassigned RNA; note = Homo sapiens erb-b2 receptor tyrosine kinase 2 (ERBB2), transcript variant 7, mRNA, NCBI Reference Sequence: NM_001382782.1
gttctttattctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 134 - RNA, 4682 nt, Homo sapiens
  source 1..4682: mol_type = unassigned RNA; note = Homo sapiens erb-b2 receptor tyrosine kinase 2 (ERBB2), transcript variant 8, mRNA, NCBI Reference Sequence: NM_001382783.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtcctgtgaagtaggtgcacagatgagaaaatggaagttcagagaaatgaagcaacttatccaaggctcccagctacccagtaatgtccagggaatttttggactctgaagaggaggcattaagagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 135 - RNA, 4674 nt, Homo sapiens
  source 1..4674: mol_type = unassigned RNA; note = Homo sapiens erb-b2 receptor tyrosine kinase 2 (ERBB2), transcript variant 9, mRNA, NCBI Reference Sequence: NM_001382784.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggagtctcactctgtcagcaggctggagtgcagtggtacgatcttggctcactgcaacctctgcctcctggattcaagcaattctcctgcctcagtctcctgagtagctgggactacagggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 136 - RNA, 4659 nt, Homo sapiens
  source 1..4659: mol_type = unassigned RNA; note = Homo sapiens erb-b2 receptor tyrosine kinase 2 (ERBB2), transcript variant 10, mRNA, NCBI Reference Sequence: NM_001382785.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggtaatgcgttttcctctctgggtgcctcccattttctggctcaagtccctgcccaggatcaagcttggaggagggccccgagggaggggccacagagactgggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 137 - RNA, 4638 nt, Homo sapiens
  source 1..4638: mol_type = unassigned RNA; note = Homo sapiens erb-b2 receptor tyrosine kinase 2 (ERBB2), transcript variant 11, mRNA, NCBI Reference Sequence: NM_001382786.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggagtctcactctgtcagcaggctggagtgcagtggtacgatcttggctcactgcaacctctgcctcctggattcaagcaattctcctgcctcagtctcctgagtagctgggactacagggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 138 - RNA, 4632 nt, Homo sapiens
  source 1..4632: mol_type = unassigned RNA; note = Homo sapiens erb-b2 receptor tyrosine kinase 2 (ERBB2), transcript variant 12, mRNA, NCBI Reference Sequence: NM_001382787.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagaaggcaggagggccccaagggaagcagaaggtgacagaaggggaaagggtcctctgatcattgctcaccccacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 139 - RNA, 4587 nt, Homo sapiens
  source 1..4587: mol_type = unassigned RNA; note = Homo sapiens erb-b2 receptor tyrosine kinase 2 (ERBB2), transcript variant 13, mRNA, NCBI Reference Sequence: NM_001382788.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtcccctgcggtcccttcctcctcactgcagtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 140 - RNA, 4578 nt, Homo sapiens
  source 1..4578: mol_type = unassigned RNA; note = Homo sapiens erb-b2 receptor tyrosine kinase 2 (ERBB2), transcript variant 14, mRNA, NCBI Reference Sequence: NM_001382789.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaagtgcccacctttctcccatagtggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 141 - RNA, 4554 nt, Homo sapiens
  source 1..4554: mol_type = unassigned RNA; note = Homo sapiens erb-b2 receptor tyrosine kinase 2 (ERBB2), transcript variant 15, mRNA, NCBI Reference Sequence: NM_001382790.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 142 - RNA, 4548 nt, Homo sapiens
  source 1..4548: mol_type = unassigned RNA; note = Homo sapiens erb-b2 receptor tyrosine kinase 2 (ERBB2), transcript variant 16, mRNA, NCBI Reference Sequence: NM_001382791.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 143 - RNA, 4521 nt, Homo sapiens
  source 1..4521: mol_type = unassigned RNA; note = Homo sapiens erb-b2 receptor tyrosine kinase 2 (ERBB2), transcript variant 17, mRNA, NCBI Reference Sequence: NM_001382792.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 144 - RNA, 4515 nt, Homo sapiens
  source 1..4515: mol_type = unassigned RNA; note = Homo sapiens erb-b2 receptor tyrosine kinase 2 (ERBB2), transcript variant 18, mRNA, NCBI Reference Sequence: NM_001382793.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 145 - RNA, 4515 nt, Homo sapiens
  source 1..4515: mol_type = unassigned RNA; note = Homo sapiens erb-b2 receptor tyrosine kinase 2 (ERBB2), transcript variant 19, mRNA, NCBI Reference Sequence: NM_001382794.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 146 - RNA, 4509 nt, Homo sapiens
  source 1..4509: mol_type = unassigned RNA; note = Homo sapiens erb-b2 receptor tyrosine kinase 2 (ERBB2), transcript variant 20, mRNA, NCBI Reference Sequence: NM_001382795.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 147 - RNA, 4470 nt, Homo sapiens
  source 1..4470: mol_type = unassigned RNA; note = Homo sapiens erb-b2 receptor tyrosine kinase 2 (ERBB2), transcript variant 21, mRNA, NCBI Reference Sequence: NM_001382796.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctgagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 148 - RNA, 4458 nt, Homo sapiens
  source 1..4458: mol_type = unassigned RNA; note = Homo sapiens erb-b2 receptor tyrosine kinase 2 (ERBB2), transcript variant 22, mRNA, NCBI Reference Sequence: NM_001382797.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaaggaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 149 - RNA, 4401 nt, Homo sapiens
  source 1..4401: mol_type = unassigned RNA; note = Homo sapiens erb-b2 receptor tyrosine kinase 2 (ERBB2), transcript variant 23, mRNA, NCBI Reference Sequence: NM_001382798.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 150 - RNA, 4377 nt, Homo sapiens
  source 1..4377: mol_type = unassigned RNA; note = Homo sapiens erb-b2 receptor tyrosine kinase 2 (ERBB2), transcript variant 24, mRNA, NCBI Reference Sequence: NM_001382799.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 151 - RNA, 4371 nt, Homo sapiens
  source 1..4371: mol_type = unassigned RNA; note = Homo sapiens erb-b2 receptor tyrosine kinase 2 (ERBB2), transcript variant 25, mRNA, NCBI Reference Sequence: NM_001382800.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 152 - RNA, 4353 nt, Homo sapiens
  source 1..4353: mol_type = unassigned RNA; note = Homo sapiens erb-b2 receptor tyrosine kinase 2 (ERBB2), transcript variant 26, mRNA, NCBI Reference Sequence: NM_001382801.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 153 - RNA, 4299 nt, Homo sapiens
  source 1..4299: mol_type = unassigned RNA; note = Homo sapiens erb-b2 receptor tyrosine kinase 2 (ERBB2), transcript variant 27, mRNA, NCBI Reference Sequence: NM_001382802.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagccacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 154 - RNA, 4262 nt, Homo sapiens
  source 1..4262: mol_type = unassigned RNA; note = Homo sapiens erb-b2 receptor tyrosine kinase 2 (ERBB2), transcript variant 28, mRNA, NCBI Reference Sequence: NM_001382803.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 155 - RNA, 3729 nt, Homo sapiens
  source 1..3729: mol_type = unassigned RNA; note = Homo sapiens erb-b2 receptor tyrosine kinase 2 (ERBB2), transcript variant 29, mRNA, NCBI Reference Sequence: NM_001382804.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 156 - RNA, 3606 nt, Homo sapiens
  source 1..3606: mol_type = unassigned RNA; note = Homo sapiens erb-b2 receptor tyrosine kinase 2 (ERBB2), transcript variant 30, mRNA, NCBI Reference Sequence: NM_001382805.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 157 - RNA, 3519 nt, Homo sapiens
  source 1..3519: mol_type = unassigned RNA; note = Homo sapiens erb-b2 receptor tyrosine kinase 2 (ERBB2), transcript variant 31, mRNA, NCBI Reference Sequence: NM_001382806.1
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 158 - RNA, 4620 nt, Homo sapiens
  source 1..4620: mol_type = unassigned RNA; note = Homo sapiens erb-b2 receptor tyrosine kinase 2 (ERBB2), transcript variant 6, non-coding RNA, NCBI Reference Sequence: NR_110535.2
cccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggtgaggcccgtgggcaacccagccaggccctgcctccagctgggctgagccctctgtttacaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 159 - RNA, 4769 nt, Homo sapiens
  source 1..4769: mol_type = unassigned RNA; note = Homo sapiens erb-b2 receptor tyrosine kinase 2 (ERBB2), transcript variant X1, mRNA, NCBI Reference Sequence: XM_024450641.1
acaggagaaggaggaggtggaggaggagggctgcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggtatgtgcctctgctttgtgcccaatgtgctctaccccccaggatgcaaggggtgggcaccctgcctggtactgccctattgcccctggcacaccagggcaaaacagcacagtgaaagccagccacctgtccccccaggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagc

SEQ ID NO: 160 - RNA, 4996 nt, Homo sapiens
  source 1..4996: mol_type = unassigned RNA; note = Homo sapiens erb-b2 receptor tyrosine kinase 2 (ERBB2), transcript variant X2, mRNA, NCBI Reference Sequence: XM_024450642.1
cggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagatacttcaaagattccagaagatatgccccgggggtcctggaagccacaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggtatgtgcctctgctttgtgcccaatgtgctctaccccccaggatgcaaggggtgggcaccctgcctggtactgccctattgcccctggcacaccagggcaaaacagcacagtgaaagccagccacctgtccccccaggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 161 - RNA, 4995 nt, Homo sapiens
  source 1..4995: mol_type = unassigned RNA; note = Homo sapiens erb-b2 receptor tyrosine kinase 2 (ERBB2), transcript variant X3, mRNA, NCBI Reference Sequence: XM_024450643.1
ctttattctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggtatgtgcctctgctttgtgcccaatgtgctctaccccccaggatgcaaggggtgggcaccctgcctggtactgccctattgcccctggcacaccagggcaaaacagcacagtgaaagccagccacctgtccccccaggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagc

SEQ ID NO: 162 - RNA, 3946 nt, Homo sapiens
  source 1..3946: mol_type = unassigned RNA; note = Homo sapiens EPH receptor A2 (EPHA2), transcript variant 1, mRNA, NCBI Reference Sequence: NM_004431.5
attaaggactcggggcaggaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatatgggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccga

SEQ ID NO: 163 - RNA, 3878 nt, Homo sapiens
  source 1..3878: mol_type = unassigned RNA; note = Homo sapiens EPH receptor A2 (EPHA2), transcript variant 2, mRNA, NCBI Reference Sequence: NM_001329090.2
attaaggactcggggcaggaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatatgggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccga

SEQ ID NO: 164 - RNA, 2143 nt, Homo sapiens
  source 1..2143: mol_type = unassigned RNA; note = Homo sapiens EPH receptor A2 (EPHA2), transcript variant X1, mRNA, NCBI Reference Sequence: XM_017000537.1
atgaatgaacaggagtcggttctcacccaacttccattaaggactcggggcaggaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggcaggaatccccgagtagctctaatgggaatgccttcgtcacgactgcttaaggggccattctggggcctagatcctggagagggagtcctggctcgctcacttcctccctgttcctccacccgccttctccgcaccctcggccctgagagtggagcttgggcagcaaaagcggggactgggccgcattctgagcaccccaggtcctcctaggaccaaagtagggccaggaggcttccctggccggagcagacctcactgacctccctgcatttggttccccgtggggc

SEQ ID NO: 165 - RNA, 3258 nt, Homo sapiens
  source 1..3258: mol_type = unassigned RNA; note = Homo sapiens ribonucleotide reductase regulatory subunit M2 (RRM2), transcript variant 2, mRNA, NCBI Reference Sequence: NM_001034.4
gtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataatttttttttttttttttgagatggagtctcgctctgttgcccaggctggagtgcagtggcgcgattttggctcactgtaacctccatctcctgggttcaagcaattctcctgtctcagcctccctagtagctgggactgcaggtatgtgctaccacacctggctaatttttgtatttttagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatgtca

SEQ ID NO: 166 - RNA, 3452 nt, Homo sapiens
  source 1..3452: mol_type = unassigned RNA; note = Homo sapiens ribonucleotide reductase regulatory subunit M2 (RRM2), transcript variant 1, mRNA, NCBI Reference Sequence: NM_001165931.1
aaaatcgcgcgcggccccgcggccagcctgggtaggggcaaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataatttttttttttttttttgagatggagtctcgctctgttgcccaggctggagtgcagtggcgcgattttggctcactgtaacctccatctcctgggttcaagcaattctcctgtctcagcctccctagtagctgggactgcaggtatgtgctaccacacctggctaatttttgtatttttagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatgtcagtttcaaaaaaaaaaaaaaaaaa

SEQ ID NO: 167 - RNA, 2178 nt, Homo sapiens
  source 1..2178: mol_type = unassigned RNA; note = Homo sapiens ribonucleotide reductase regulatory subunit M2 (RRM2), transcript variant 3, non-coding RNA, NCBI Reference Sequence: NR_164157.1
gtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggtgctgggagaccgtgaagtgcaaagcagatggagtccaggccctcggggagacagcacgccagtgagggagatggagaccaatcacccacccagtgtgcggggatgagaagctcgggaaggtctgaccagccttacgtcttgaaagggaatcccctgcttctgcgtgtcaggtgttactcggggtgcgccagtggaagcgggaggcagttgcagctttcagagatggggttttgcatgttggccaggctggtcttgaactcctgagtgtaagagttgaagaaagaagaaagaaacacgaaaagtggctcaacagtccaagacaggtttattttggagaataaacctgagaggggcttctggccgattgctgtcaggagcactctctcttacagactaaggtcttccaggatctcaaccagttctctcactgcagagtctggagaagcccagccctcattgtgaagggagagccaccgtggtgctcacagcaagacacccagagtcccttccagacagggacacccctggagcgaccctgtttcagaatgaagttatctgggtgggaactcaccaagaatgcacagagggcgctgggctccaagcttcagcatatcctttcactggactccacacaggcctgcggagcaggtggacccaccattctcagaccccccagggccccatagacagcagatctgctgctttcaatcacacccactgcctctcatgccggagtgggggaaatggaacccgcaaagcctgcaggccagggagggtgggaaactggggtgatgtgagcccacagggtggagcactgtggactgaatgcctgtgtcccctgggttcatatgttgaacccctaactcccaatgtgatggtgtcaggaggtggagcctttgggaggtggttaggccgtgagggtggagacccatgctggggttggtgcccttatggttctcccatgtgaggacacagagggcagccatctacaagccaagaagagaggcctcaccagacaccaaacctgccggcaccttgctgtgagatttccagcccccagagctgtgagaaataaatttctgttgtttaaggcactcaa

SEQ ID NO: 168 - RNA, 1017 nt, Homo sapiens
  source 1..1017: mol_type = unassigned RNA; note = Homo sapiens proteasome 20S subunit beta 9 (PSMB9), mRNA, NCBI Reference Sequence: NM_002800.5
agtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaacctggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaa

SEQ ID NO: 169 - RNA, 1124 nt, Homo sapiens
  source 1..1124: mol_type = unassigned RNA; note = Homo sapiens proteasome 20S subunit beta 8 (PSMB8), transcript variant 2, mRNA, NCBI Reference Sequence: NM_148919.4
gctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 170 - RNA, 1327 nt, Homo sapiens
  source 1..1327: mol_type = unassigned RNA; note = Homo sapiens proteasome 20S subunit beta 8 (PSMB8), transcript variant 1, mRNA, NCBI Reference Sequence: NM_004159.5
aaactccgcagtgctcagccaagcagggagcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 171 - RNA, 3950 nt, Homo sapiens
  source 1..3950: mol_type = unassigned RNA; note = Homo sapiens MCL1 apoptosis regulator, BCL2 family member (MCL1), transcript variant 1, mRNA, NCBI Reference Sequence: NM_021960.5
acttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaa

SEQ ID NO: 172 - RNA, 3702 nt, Homo sapiens
  source 1..3702: mol_type = unassigned RNA; note = Homo sapiens MCL1 apoptosis regulator, BCL2 family member (MCL1), transcript variant 2, mRNA, NCBI Reference Sequence: NM_182763.3
acttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaa

SEQ ID NO: 173 - RNA, 3491 nt, Homo sapiens
  source 1..3491: mol_type = unassigned RNA; note = Homo sapiens MCL1 apoptosis regulator, BCL2 family member (MCL1), transcript variant 3, mRNA, NCBI Reference Sequence: NM_001197320.2
acttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaa

SEQ ID NO: 174 - RNA, 6749 nt, Homo sapiens
  source 1..6749: mol_type = unassigned RNA; note = Homo sapiens Cbl proto-oncogene B (CBLB), transcript variant 2, mRNA, NCBI Reference Sequence: NM_170662.5
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 175 - RNA, 6685 nt, Homo sapiens
  source 1..6685: mol_type = unassigned RNA; note = Homo sapiens Cbl proto-oncogene B (CBLB), transcript variant 1, mRNA, NCBI Reference Sequence: NM_001321786.1
ggggccgggaaggggcctgagcagggaagggacacaggcgtcctgaaacaaagctttgggttgagggcagaggcgaggagccagagaagtgaactcctcctttccgtggccgctcttgtcatttttctcttttctcttttcaaatgggctatttgtgtgttaatttcatttggttcttgggaataacgactcaccgcgttgatttaaagaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 176 - RNA, 6573 nt, Homo sapiens
  source 1..6573: mol_type = unassigned RNA; note = Homo sapiens Cbl proto-oncogene B (CBLB), transcript variant 3, mRNA, NCBI Reference Sequence: NM_001321788.2
gtccagcgagcggtctcctcctcctgctagtgctgctgcggcgtcccgcggcctccccgagtcgggcgggaggggagagcgggtgtggatttgtcttgacgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 177 - RNA, 6476 nt, Homo sapiens
  source 1..6476: mol_type = unassigned RNA; note = Homo sapiens Cbl proto-oncogene B (CBLB), transcript variant 4, mRNA, NCBI Reference Sequence: NM_001321789.1
gagggcagaggcgaggagccagagaagtgaactcctcctttccgtggccgctcttgtcatttttctcttttctcttttcaaatgggctatttgtgtgttaatttcatttggttcttgggaataacgactcaccgcgttgatttaaagaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 178 - RNA, 6405 nt, Homo sapiens
  source 1..6405: mol_type = unassigned RNA; note = Homo sapiens Cbl proto-oncogene B (CBLB), transcript variant 5, mRNA, NCBI Reference Sequence: NM_001321790.2
ctttcagccccagatggctttggctcccggtcccgacgctcacgcccacctgccaccccttattgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 179 - RNA, 6441 nt, Homo sapiens
  source 1..6441: mol_type = unassigned RNA; note = Homo sapiens Cbl proto-oncogene B (CBLB), transcript variant 6, mRNA, NCBI Reference Sequence: NM_001321791.2
gtccagcgagcggtctcctcctcctgctagtgctgctgcggcgtcccgcggcctccccgagtcgggcgggaggggagagcgggtgtggatttgtcttgacgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 180 - RNA, 6617 nt, Homo sapiens
  source 1..6617: mol_type = unassigned RNA; note = Homo sapiens Cbl proto-oncogene B (CBLB), transcript variant 7, mRNA, NCBI Reference Sequence: NM_001321793.2
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 181 - RNA, 6426 nt, Homo sapiens
  source 1..6426: mol_type = unassigned RNA; note = Homo sapiens Cbl proto-oncogene B (CBLB), transcript variant 8, mRNA, NCBI Reference Sequence: NM_001321794.2
gtccagcgagcggtctcctcctcctgctagtgctgctgcggcgtcccgcggcctccccgagtcgggcgggaggggagagcgggtgtggatttgtcttgacgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 182 - RNA, 6602 nt, Homo sapiens
  source 1..6602: mol_type = unassigned RNA; note = Homo sapiens Cbl proto-oncogene B (CBLB), transcript variant 9, mRNA NCBI Reference Sequence: NM_001321795.2
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 183 - RNA, 6426 nt, Homo sapiens
  source 1..6426: mol_type = unassigned RNA; note = Homo sapiens Cbl proto-oncogene B (CBLB), transcript variant 10, mRNA, NCBI Reference Sequence: NM_001321796.2
gtccagcgagcggtctcctcctcctgctagtgctgctgcggcgtcccgcggcctccccgagtcgggcgggaggggagagcgggtgtggatttgtcttgacgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 184 - RNA, 6294 nt, Homo sapiens
  source 1..6294: mol_type = unassigned RNA; note = Homo sapiens Cbl proto-oncogene B (CBLB), transcript variant 11, mRNA, NCBI Reference Sequence: NM_001321797.2
gtccagcgagcggtctcctcctcctgctagtgctgctgcggcgtcccgcggcctccccgagtcgggcgggaggggagagcgggtgtggatttgtcttgacgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 185 - RNA, 6470 nt, Homo sapiens
  source 1..6470: mol_type = unassigned RNA; note = Homo sapiens Cbl proto-oncogene B (CBLB), transcript variant 12, mRNA, NCBI Reference Sequence: NM_001321798.2
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 186 - RNA, 6470 nt, Homo sapiens
  source 1..6470: mol_type = unassigned RNA; note = Homo sapiens Cbl proto-oncogene B (CBLB), transcript variant 13, mRNA, NCBI Reference Sequence: NM_001321799.2
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 187 - RNA, 6416 nt, Homo sapiens
  source 1..6416: mol_type = unassigned RNA; note = Homo sapiens Cbl proto-oncogene B (CBLB), transcript variant 14, mRNA, NCBI Reference Sequence: NM_001321806.2
gtccagcgagcggtctcctcctcctgctagtgctgctgcggcgtcccgcggcctccccgagtcgggcgggaggggagagcgggtgtggatttgtcttgacgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 188 - RNA, 6893 nt, Homo sapiens
  source 1..6893: mol_type = unassigned RNA; note = Homo sapiens Cbl proto-oncogene B (CBLB), transcript variant 15, mRNA, NCBI Reference Sequence: NM_001321807.2
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcaggtttctgataattttacagaatatcttatttatttaacatgatacaaagacattctaaatagtaagagctttgcttcttcaccttgtcaaggaagagagtaaaagtaatcttcctacattaaacctaactgctcattctaggaaccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 189 - RNA, 6585 nt, Homo sapiens
  source 1..6585: mol_type = unassigned RNA; note = Homo sapiens Cbl proto-oncogene B (CBLB), transcript variant 16, mRNA, NCBI Reference Sequence: NM_001321808.2
gtccagcgagcggtctcctcctcctgctagtgctgctgcggcgtcccgcggcctccccgagtcgggcgggaggggagagcgggtgtggatttgtcttgacgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcaggtttctgataattttacagaatatcttatttatttaacatgatacaaagacattctaaatagtaagagctttgcttcttcaccttgtcaaggaagagagtaaaagtaatcttcctacattaaacctaactgctcattctaggaaccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 190 - RNA, 6445 nt, Homo sapiens
  source 1..6445: mol_type = unassigned RNA; note = Homo sapiens Cbl proto-oncogene B (CBLB), transcript variant 17, mRNA, NCBI Reference Sequence: NM_001321811.2
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 191 - RNA, 6514 nt, Homo sapiens
  source 1..6514: mol_type = unassigned RNA; note = Homo sapiens Cbl proto-oncogene B (CBLB), transcript variant 18, mRNA, NCBI Reference Sequence: NM_001321813.1
aactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagttctttgtgaattaccattgtgatcttctaaaggcaaaaaaaatgacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcaggtttctgataattttacagaatatcttatttatttaacatgatacaaagacattctaaatagtaagagctttgcttcttcaccttgtcaaggaagagagtaaaagtaatcttcctacattaaacctaactgctcattctaggaaccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 192 - RNA, 6313 nt, Homo sapiens
  source 1..6313: mol_type = unassigned RNA; note = Homo sapiens Cbl proto-oncogene B (CBLB), transcript variant 19, mRNA, NCBI Reference Sequence: NM_001321816.2
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 193 - RNA, 6749 nt, Homo sapiens
  source 1..6749: mol_type = unassigned RNA; note = Homo sapiens Cbl proto-oncogene B (CBLB), transcript variant 20, mRNA, NCBI Reference Sequence: NM_001321820.2
gtccagcgagcggtctcctcctcctgctagtgctgctgcggcgtcccgcggcctccccgagtcgggcgggaggggagagcgggtgtggatttgtcttgacgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcaggtttctgataattttacagaatatcttatttatttaacatgatacaaagacattctaaatagtaagagctttgcttcttcaccttgtcaaggaagagagtaaaagtaatcttcctacattaaacctaactgctcattctaggaaccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcagccagaagttattgagtttctgtgggagatactgtgctttgaaaattcttggtatggatccaacctattctcagtgcatttatatacatataatttttccagttataattgctatgtttaaaaaaagatttgtggcaacctcatagctacatgaaatatagcaaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 194 - RNA, 6799 nt, Homo sapiens
  source 1..6799: mol_type = unassigned RNA; note = Homo sapiens Cbl proto-oncogene B (CBLB), transcript variant 21, mRNA, NCBI Reference Sequence: NM_001321822.2
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcagccagaagttattgagtttctgtgggagatactgtgctttgaaaattcttggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 195 - RNA, 6974 nt, Homo sapiens
  source 1..6974: mol_type = unassigned RNA; note = Homo sapiens Cbl proto-oncogene B (CBLB), transcript variant 22, non-coding RNA, NCBI Reference Sequence: NR_135806.2
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaagtctctgccagcaccctgaaatttctacatttgtaaaacaatttgctattgatattttctctcatttgcttcatctctaaaggaagaggtagtagaaaccaccactgtctttttgcagaagtttaaatggagaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagagagcccagtttaccctatggctgacaaatagcaaacttaggatatgatgcaagatagaacatgataatgattcaaaacagaaccataagcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 196 - RNA, 6820 nt, Homo sapiens
  source 1..6820: mol_type = unassigned RNA; note = Homo sapiens Cbl proto-oncogene B (CBLB), transcript variant 23, non-coding RNA, NCBI Reference Sequence: NR_135807.2
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagcagttctttgtgaattaccattgtgatcttctaaaggcaaaaaaaatgacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatgccccgtctctgactgccaagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 197 - RNA, 6775 nt, Homo sapiens
  source 1..6775: mol_type = unassigned RNA; note = Homo sapiens Cbl proto-oncogene B (CBLB), transcript variant 24, non-coding RNA, NCBI Reference Sequence: NR_135808.2
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatgccccgtctctgactgccaaggtgatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 198 - RNA, 6731 nt, Homo sapiens
  source 1..6731: mol_type = unassigned RNA; note = Homo sapiens Cbl proto-oncogene B (CBLB), transcript variant 25, non-coding RNA, NCBI Reference Sequence: NR_135809.2
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagaatatgttttagattttgcccaagtctgtatcgttgcctgagttttcaagctgtcagaatcctgggataattagatctgatgtgagccctcagacaaagtccaggatgtgactgtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 199 - RNA, 6686 nt, Homo sapiens
  source 1..6686: mol_type = unassigned RNA; note = Homo sapiens Cbl proto-oncogene B (CBLB), transcript variant 26, non-coding RNA, NCBI Reference Sequence: NR_135810.2
ctttcagccccagatggctttggctcccggtcccgacgctcacgcccacctgccaccccttattgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagcctgaatgcttccaactttataatttgctttagagagcccagtttaccctatggctgacaaatagcaaacttaggatatgatgcaagatagaacatgataatgattcaaaacagaaccataagcagatgccccgtctctgactgccaagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 200 - RNA, 6596 nt, Homo sapiens
  source 1..6596: mol_type = unassigned RNA; note = Homo sapiens Cbl proto-oncogene B (CBLB), transcript variant 27, non-coding RNA, NCBI Reference Sequence: NR_135811.2
gtccagcgagcggtctcctcctcctgctagtgctgctgcggcgtcccgcggcctccccgagtcgggcgggaggggagagcgggtgtggatttgtcttgacgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatgccccgtctctgactgccaagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 201 - RNA, 6486 nt, Homo sapiens
  source 1..6486: mol_type = unassigned RNA; note = Homo sapiens Cbl proto-oncogene B (CBLB), transcript variant 28, non-coding RNA, NCBI Reference Sequence: NR_135812.1
gagggagagggcgtccaggcagacggcgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagggtctcactctgttgcccaggctggagtacagtggtgcgatctcagttcactgcaacctctgcctccaaggttcaagtgattctcctgcctctaccccctaagtagctgggattacagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 202 - RNA, 6600 nt, Homo sapiens
  source 1..6600: mol_type = unassigned RNA; note = Homo sapiens Cbl proto-oncogene B (CBLB), transcript variant X2, mRNA, NCBI Reference Sequence: XM_011513257.1
gctgtcctgggtagaagggtttggcagccctagggagatgaatttctccagcgttggacccgcccagagcggagaagcaacacccttccagccactactctgttgctatgaaacaaaagactaggaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 203 - RNA, 4213 nt, Homo sapiens
  source 1..4213: mol_type = unassigned RNA; note = Homo sapiens Cbl proto-oncogene B (CBLB), transcript variant X10, mRNA, NCBI Reference Sequence: XM_011513259.3
tcccctcccagtccaccttcctcctgcagctcagacccgaggggccgggaaggggcctgagcagggaagggacacaggcgtcctgaaacaaagctttgggttgagggcagaggcgaggagccagagaagtgaactcctcctttccgtggccgctcttgtcatttttctcttttctcttttcaaatgggctatttgtgtgttaatttcatttggttcttgggaataacgactcaccgcgttgatttaaagaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagagagcccagtttaccctatggctgacaaatagcaaacttaggatatgatgcaagatagaacatgataatgattcaaaacagaaccataagcaggtatttttgctatttataataatattttgagtgtatctagtaccttttaaataatatagtttaatggaagaatatagtacagtggtatattttatagtctatgtatggctctgaagtgtatccagagtttactttttaaccttaaataaatagatgattagaaatagcattaagtgtatttgacaaacctataaatttcccgtaaagaaataagcaagtgtatgtattgtaaaagacagtctttcctctgacttaatgttgtatcaggggcatttagagtctacaagaacctaaagtaaattttatgaaatatctagtgcaaaatctttgggaaatttcaaaatttatgctgaaatcaccatatttgtttcctttggtttctctaacaaaccaaaagatcaacattgtctcatgcgatttatcttctcattccttcctaaaaatatttctggaaaattaatggagctggaccaccaattcttcaaatattgaaaactcaaaatctaagagttattttaatcttgaaattaatgaaaacaagttaaagagccttgtctaagtcaaaaagtcctcagcaaagctggtgataattattatactccaaaaaaggtgaaaagataatggcttcaaatcctgccttacattatccagtcaaaaactaatataaaaatagtcaatatttaagcctatgttttcatcgtaagtaatcaaatacttacatattattaatgtctaagggagtggaagttaaaacaatgaaattcaatcgggtcttctttaatatttacaatttttgctttacattagcaattcaggtttcactgattttaaaattgtgaacaatctgaatttgtgtggatttatttgtggtagttaaaagtaaatattaagtgcaagctatttgccaagagtgttctaggtgctatgtttgatttaggaggtataattcaaacatgagaagtaggaaaagatccctcagatccctgtcctcagaagaattgacggtactttcagagatatcgacaacataaaagtactatgagaggaaagcagcggtgcctgaggtgggagtgatagctagataaattattagtgaaccaaggttttcagatgtaatgtttgtctactcaaaaagggaatcaattctctaagaatttaaacccatataatactatgaatgttaaaccagttgggtttatggtattaatgatttaatacagcaacactgacaaaatctctttttctccctttagttccagttagtaaatatcatattttttacta

SEQ ID NO: 204 - RNA, 6552 nt, Homo sapiens
  source 1..6552: mol_type = unassigned RNA; note = Homo sapiens Cbl proto-oncogene B (CBLB), transcript variant X1, mRNA, NCBI Reference Sequence: XM_017007395.1
agcaggaagtcccgcctttcagccccagatggctttggctcccggtcccgacgctcacgcccacctgccaccccttattgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 205 - RNA, 6577 nt, Homo sapiens
  source 1..6577: mol_type = unassigned RNA; note = Homo sapiens Cbl proto-oncogene B (CBLB), transcript variant X4, mRNA, NCBI Reference Sequence: XM_017007397.1
cccctcccagtccaccttcctcctgcagctcagacccgaggggccgggaaggggcctgagcagggaagggacacaggcgtcctgaaacaaagctttgggttgagggcagaggcgaggagccagagaagtgaactcctcctttccgtggccgctcttgtcatttttctcttttctcttttcaaatgggctatttgtgtgttaatttcatttggttcttgggaataacgactcaccgcgttgatttaaagaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 206 - RNA, 6591 nt, Homo sapiens
  source 1..6591: mol_type = unassigned RNA; note = Homo sapiens Cbl proto-oncogene B (CBLB), transcript variant X3, mRNA, NCBI Reference Sequence: XM_017007396.1
ccctcccagtccaccttcctcctgcagctcagacccgaggggccgggaaggggcctgagcagggaagggacacaggcgtcctgaaacaaagctttgggttgagggcagaggcgaggagccagagaagtgaactcctcctttccgtggccgctcttgtcatttttctcttttctcttttcaaatgggctatttgtgtgttaatttcatttggttcttgggaataacgactcaccgcgttgatttaaagaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 207 - RNA, 6628 nt, Homo sapiens
  source 1..6628: mol_type = unassigned RNA; note = Homo sapiens Cbl proto-oncogene B (CBLB), transcript variant X6, mRNA, NCBI Reference Sequence: XM_017007399.1
tcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 208 - RNA, 6403 nt, Homo sapiens
  source 1..6403: mol_type = unassigned RNA; note = Homo sapiens Cbl proto-oncogene B (CBLB), transcript variant X5, mRNA, NCBI Reference Sequence: XM_017007398.1
caggaagtcccgcctttcagccccagatggctttggctcccggtcccgacgctcacgcccacctgccaccccttattgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 209 - RNA, 6445 nt, Homo sapiens
  source 1..6445: mol_type = unassigned RNA; note = Homo sapiens Cbl proto-oncogene B (CBLB), transcript variant X7, mRNA, NCBI Reference Sequence: XM_017007400.1
cccctcccagtccaccttcctcctgcagctcagacccgaggggccgggaaggggcctgagcagggaagggacacaggcgtcctgaaacaaagctttgggttgagggcagaggcgaggagccagagaagtgaactcctcctttccgtggccgctcttgtcatttttctcttttctcttttcaaatgggctatttgtgtgttaatttcatttggttcttgggaataacgactcaccgcgttgatttaaagaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 210 - RNA, 6751 nt, Homo sapiens
  source 1..6751: mol_type = unassigned RNA; note = Homo sapiens Cbl proto-oncogene B (CBLB), transcript variant X8, misc_RNA, NCBI Reference Sequence: XR_001740338.1
tcccctcccagtccaccttcctcctgcagctcagacccgaggggccgggaaggggcctgagcagggaagggacacaggcgtcctgaaacaaagctttgggttgagggcagaggcgaggagccagagaagtgaactcctcctttccgtggccgctcttgtcatttttctcttttctcttttcaaatgggctatttgtgtgttaatttcatttggttcttgggaataacgactcaccgcgttgatttaaagaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatgccccgtctctgactgccaaggtgatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 211 - RNA, 6748 nt, Homo sapiens
  source 1..6748: mol_type = unassigned RNA; note = Homo sapiens Cbl proto-oncogene B (CBLB), transcript variant X9, misc_RNA, NCBI Reference Sequence: XR_001740339.1
tcccctcccagtccaccttcctcctgcagctcagacccgaggggccgggaaggggcctgagcagggaagggacacaggcgtcctgaaacaaagctttgggttgagggcagaggcgaggagccagagaagtgaactcctcctttccgtggccgctcttgtcatttttctcttttctcttttcaaatgggctatttgtgtgttaatttcatttggttcttgggaataacgactcaccgcgttgatttaaagaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatgccccgtctctgactgccaagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 212 - RNA, 1805 nt, Homo sapiens
  source 1..1805: mol_type = unassigned RNA; note = Homo sapiens ras homolog family member A (RHOA), transcript variant 1, mRNA, NCBI Reference Sequence: NM_001664.4
gctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 213 - RNA, 1900 nt, Homo sapiens
  source 1..1900: mol_type = unassigned RNA; note = Homo sapiens ras homolog family member A (RHOA), transcript variant 2, mRNA, NCBI Reference Sequence: NM_001313941.2
gctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagagatggtgtcttgctatgttgcccagacagatcttgtactcctgggctcaagttgtcctcctgcctcagcctcccaaagtgctgggattaaagatcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 214 - RNA, 1944 nt, Homo sapiens
  source 1..1944: mol_type = unassigned RNA; note = Homo sapiens ras homolog family member A (RHOA), transcript variant 3, mRNA, NCBI Reference Sequence: NM_001313943.2
gctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagcctcactgtgtcgccaggctggagtgctgtggcacgatcttggctcaactgcaacctccgcctcccagatttaagcgattcccctgcctcagcctcctgagtagctggggttacaggcgcccactaccacacccaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 215 - RNA, 1745 nt, Homo sapiens
  source 1..1745: mol_type = unassigned RNA; note = Homo sapiens ras homolog family member A (RHOA), transcript variant 4, mRNA, NCBI Reference Sequence: NM_001313944.2
gctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 216 - RNA, 1682 nt, Homo sapiens
  source 1..1682: mol_type = unassigned RNA; note = Homo sapiens ras homolog family member A (RHOA), transcript variant 5, mRNA, NCBI Reference Sequence: NM_001313945.2
gctctctcgcgctaccctcccgccgcccgcggtcctccgtcggttctctcgttagtccacggtctggtcttcagctacccgccttcgtctccgagtttgcgactcgcggaccggcgtccccggcgcgaagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 217 - RNA, 1553 nt, Homo sapiens
  source 1..1553: mol_type = unassigned RNA; note = Homo sapiens ras homolog family member A (RHOA), transcript variant 6, mRNA, NCBI Reference Sequence: NM_001313946.2
gctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 218 - RNA, 1684 nt, Homo sapiens
  source 1..1684: mol_type = unassigned RNA; note = Homo sapiens ras homolog family member A (RHOA), transcript variant 7, mRNA, NCBI Reference Sequence: NM_001313947.2
gctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 219 - RNA, 3825 nt, Homo sapiens
  source 1..3825: mol_type = unassigned RNA; note = Homo sapiens Fli-1 proto-oncogene, ETS transcription factor (FLI1), transcript variant 1, mRNA, NCBI Reference Sequence: NM_002017.5
ctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattcta

SEQ ID NO: 220 - RNA, 3879 nt, Homo sapiens
  source 1..3879: mol_type = unassigned RNA; note = Homo sapiens Fli-1 proto-oncogene, ETS transcription factor (FLI1), transcript variant 2, mRNA, NCBI Reference Sequence: NM_001167681.3
ctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaattctttctctgggtcatccactgctgagccccctccccaggaagtggaattgaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattcta

SEQ ID NO: 221 - RNA, 3996 nt, Homo sapiens
  source 1..3996: mol_type = unassigned RNA; note = Homo sapiens Fli-1 proto-oncogene, ETS transcription factor (FLI1), transcript variant 3, mRNA, NCBI Reference Sequence: NM_001271010.2
ctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggcgccagctgcctcattaaagagcagccttttatgctgggcttcacctgtacccaccctgagcggcagccgtggagccccatggccgcacgcagggcttgcgctggctggaggaggcacggtgcttgggagctgcaagaatggagggaggactggcaggcgagcgggcgagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattcta

SEQ ID NO: 222 - RNA, 3428 nt, Homo sapiens
  source 1..3428: mol_type = unassigned RNA; note = Homo sapiens Fli-1 proto-oncogene, ETS transcription factor (FLI1), transcript variant 4, mRNA, NCBI Reference Sequence: NM_001271012.2
acagtctctccatctgcatccccacttcatcaccatcccaccgtctctccctcgctccactcgcgggtaaccgaggcttctccctcccaggctggttcttgggcgttcccgacccttagctacccacgatgtttcagacagtccccgacacgtcgtcttacatcaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattcta

SEQ ID NO: 223 - RNA, 2945 nt, Homo sapiens
  source 1..2945: mol_type = unassigned RNA; note = Homo sapiens Fli-1 proto-oncogene, ETS transcription factor (FLI1), transcript variant X1, mRNA, NCBI Reference Sequence: XM_011542701.2
gcgggcctccgggtctcaccccgggaaaagtctgggtctgctctgcgctgttgcgtgctgcgctcctgggacctgctgactgtcctagagggaacgtcccgcggtagtgtcagttccctggggaccaggaagggcgactcttgcctgggagtcagtgcttgggccgtcgggtccgggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctca

SEQ ID NO: 224 - RNA, 3150 nt, Homo sapiens
  source 1..3150: mol_type = unassigned RNA; note = Homo sapiens Fli-1 proto-oncogene, ETS transcription factor (FLI1), transcript variant X4, mRNANCBI Reference Sequence: XM_011542702.1
aggagcaagtatcctgtgtgcgcagcgcatgaatgtgtctgggcatctccgcgtatatttatatagtgtgtgatgcgaaaagcaggaccagcaggggaggaagagggggtgtggggggggagggaagacgagggagagcagaggggagagaagagagaggagagctcgaggcgagagagagagagagagagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctca

SEQ ID NO: 225 - RNA, 2880 nt, Homo sapiens
  source 1..2880: mol_type = unassigned RNA; note = Homo sapiens Fli-1 proto-oncogene, ETS transcription factor (FLI1), transcript variant X3, mRNA, NCBI Reference Sequence: XM_017017405.1
tggctgggttctgggagctctgggcacacaggataggcaccaagaactaacacatcctggagctgcccggagttccgctcctgcgggcttagcaggaaagggtgcctaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcag

SEQ ID NO: 226 - RNA, 3069 nt, Homo sapiens
  source 1..3069: mol_type = unassigned RNA; note = Homo sapiens Fli-1 proto-oncogene, ETS transcription factor (FLI1), transcript variant X2, mRNA, NCBI Reference Sequence: XM_017017406.1
aggtctggtcacgttcagacccgtgtctgtattcgaacccaaaattggagccgaattgatgagactaatttctagagagggagggggagggagggagacgagtgagctctcgggctcaattgctcctgaagaaataaagaattaataagtcaccttttttcgcctctgtggacacccttttgaaattttttcttccaattgacttggatctcctctggattttttttccctctttcccccgtcggactcttaaataaaagtgagcaagtccaaagcgtggtccggagagcgtggacaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcag

SEQ ID NO: 227 - RNA, 2400 nt, Homo sapiens
  source 1..2400: mol_type = unassigned RNA; note = Homo sapiens EWS RNA binding protein 1 (EWSR1), transcript variant 2, mRNA, NCBI Reference Sequence: NM_005243.4
gcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaaga

SEQ ID NO: 228 - RNA, 2415 nt, Homo sapiens
  source 1..2415: mol_type = unassigned RNA; note = Homo sapiens EWS RNA binding protein 1 (EWSR1), transcript variant 1, mRNA, NCBI Reference Sequence: NM_013986.4
gcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactgtagaagggaccagtacaggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaaga

SEQ ID NO: 229 - RNA, 2397 nt, Homo sapiens
  source 1..2397: mol_type = unassigned RNA; note = Homo sapiens EWS RNA binding protein 1 (EWSR1), transcript variant 3, mRNA, NCBI Reference Sequence: NM_001163285.2
gcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaaga

SEQ ID NO: 230 - RNA, 2232 nt, Homo sapiens
  source 1..2232: mol_type = unassigned RNA; note = Homo sapiens EWS RNA binding protein 1 (EWSR1), transcript variant 4, mRNA, NCBI Reference Sequence: NM_001163286.2
gcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaaga

SEQ ID NO: 231 - RNA, 1315 nt, Homo sapiens
  source 1..1315: mol_type = unassigned RNA; note = Homo sapiens EWS RNA binding protein 1 (EWSR1), transcript variant 5, mRNA, NCBI Reference Sequence: NM_001163287.2
gcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaa

SEQ ID NO: 232 - RNA, 2252 nt, Homo sapiens
  source 1..2252: mol_type = unassigned RNA; note = Homo sapiens EWS RNA binding protein 1 (EWSR1), transcript variant X2, mRNA NCBI Reference Sequence: XM_005261389.4
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 233 - RNA, 2286 nt, Homo sapiens
  source 1..2286: mol_type = unassigned RNA; note = Homo sapiens EWS RNA binding protein 1 (EWSR1), transcript variant X19, mRNA, NCBI Reference Sequence: XM_005261390.4
agatttgcgcctgcgcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 234 - RNA, 2425 nt, Homo sapiens
  source 1..2425: mol_type = unassigned RNA; note = Homo sapiens EWS RNA binding protein 1 (EWSR1), transcript variant X1, mRNA, NCBI Reference Sequence: XM_011529995.3
ggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 235 - RNA, 2413 nt, Homo sapiens
  source 1..2413: mol_type = unassigned RNA; note = Homo sapiens EWS RNA binding protein 1 (EWSR1), transcript variant X3, mRNA, NCBI Reference Sequence: XM_011529996.3
ggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtt

SEQ ID NO: 236 - RNA, 2386 nt, Homo sapiens
  source 1..2386: mol_type = unassigned RNA; note = Homo sapiens EWS RNA binding protein 1 (EWSR1), transcript variant X5, mRNA, NCBI Reference Sequence: XM_011529997.2
ggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 237 - RNA, 2383 nt, Homo sapiens
  source 1..2383: mol_type = unassigned RNA; note = Homo sapiens EWS RNA binding protein 1 (EWSR1), transcript variant X6, mRNA, NCBI Reference Sequence: XM_011529998.2
ggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 238 - RNA, 2374 nt, Homo sapiens
  source 1..2374: mol_type = unassigned RNA; note = Homo sapiens EWS RNA binding protein 1 (EWSR1), transcript variant X7, mRNA, NCBI Reference Sequence: XM_011529999.3
ggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 239 - RNA, 2336 nt, Homo sapiens
  source 1..2336: mol_type = unassigned RNA; note = Homo sapiens EWS RNA binding protein 1 (EWSR1), transcript variant X11, mRNA, NCBI Reference Sequence: XM_011530000.2
ggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagt

SEQ ID NO: 240 - RNA, 2261 nt, Homo sapiens
  source 1..2261: mol_type = unassigned RNA; note = Homo sapiens EWS RNA binding protein 1 (EWSR1), transcript variant X18, mRNA, NCBI Reference Sequence: XM_011530001.2
agagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 241 - RNA, 2206 nt, Homo sapiens
  source 1..2206: mol_type = unassigned RNA; note = Homo sapiens EWS RNA binding protein 1 (EWSR1), transcript variant X27, mRNA, NCBI Reference Sequence: XM_011530002.3
ggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 242 - RNA, 2426 nt, Homo sapiens
  source 1..2426: mol_type = unassigned RNA; note = Homo sapiens EWS RNA binding protein 1 (EWSR1), transcript variant X4, mRNA, NCBI Reference Sequence: XM_017028644.2
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtt

SEQ ID NO: 243 - RNA, 2387 nt, Homo sapiens
  source 1..2387: mol_type = unassigned RNA; note = Homo sapiens EWS RNA binding protein 1 (EWSR1), transcript variant X8, mRNA, NCBI Reference Sequence: XM_017028645.2
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 244 - RNA, 2372 nt, Homo sapiens
  source 1..2372: mol_type = unassigned RNA; note = Homo sapiens EWS RNA binding protein 1 (EWSR1), transcript variant X9, mRNA, NCBI Reference Sequence: XM_017028646.2
ggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagt

SEQ ID NO: 245 - RNA, 2198 nt, Homo sapiens
  source 1..2198: mol_type = unassigned RNA; note = Homo sapiens EWS RNA binding protein 1 (EWSR1), transcript variant X10, mRNA, NCBI Reference Sequence: XM_017028647.2
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 246 - RNA, 2302 nt, Homo sapiens
  source 1..2302: mol_type = unassigned RNA; note = Homo sapiens EWS RNA binding protein 1 (EWSR1), transcript variant X13, mRNA, NCBI Reference Sequence: XM_017028649.2
ggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 247 - RNA, 4318 nt, Homo sapiens
  source 1..4318: mol_type = unassigned RNA; note = Homo sapiens EWS RNA binding protein 1 (EWSR1), transcript variant X12, mRNA, NCBI Reference Sequence: XM_017028648.2
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtaagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 248 - RNA, 2263 nt, Homo sapiens
  source 1..2263: mol_type = unassigned RNA; note = Homo sapiens EWS RNA binding protein 1 (EWSR1), transcript variant X14, mRNA, NCBI Reference Sequence: XM_017028650.2
ggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 249 - RNA, 2276 nt, Homo sapiens
  source 1..2276: mol_type = unassigned RNA; note = Homo sapiens EWS RNA binding protein 1 (EWSR1), transcript variant X15, mRNA, NCBI Reference Sequence: XM_017028651.2
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 250 - RNA, 2260 nt, Homo sapiens
  source 1..2260: mol_type = unassigned RNA; note = Homo sapiens EWS RNA binding protein 1 (EWSR1), transcript variant X16, mRNA, NCBI Reference Sequence: XM_017028652.2
ggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 251 - RNA, 2273 nt, Homo sapiens
  source 1..2273: mol_type = unassigned RNA; note = Homo sapiens EWS RNA binding protein 1 (EWSR1), transcript variant X17, mRNA, NCBI Reference Sequence: XM_017028653.2
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 252 - RNA, 2258 nt, Homo sapiens
  source 1..2258: mol_type = unassigned RNA; note = Homo sapiens EWS RNA binding protein 1 (EWSR1), transcript variant X20, mRNA, NCBI Reference Sequence: XM_017028654.1
agagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 253 - RNA, 2283 nt, Homo sapiens
  source 1..2283: mol_type = unassigned RNA; note = Homo sapiens EWS RNA binding protein 1 (EWSR1), transcript variant X21, mRNA, NCBI Reference Sequence: XM_017028655.1
agatttgcgcctgcgcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 254 - RNA, 2265 nt, Homo sapiens
  source 1..2265: mol_type = unassigned RNA; note = Homo sapiens EWS RNA binding protein 1 (EWSR1), transcript variant X22, mRNA, NCBI Reference Sequence: XM_017028656.2
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagt

SEQ ID NO: 255 - RNA, 6203 nt, Homo sapiens
  source 1..6203: mol_type = unassigned RNA; note = Homo sapiens EWS RNA binding protein 1 (EWSR1), transcript variant X23, mRNA, NCBI Reference Sequence: XM_017028657.2
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactgtagaagggaccagtacaggtttgactatcctgctcattcttgcatgggaaatgctttccatcttgtctaaccctgtaatgttaatcctttaggtgttttcatttgttgaacccccaaactttctaacatcacacacagcaaggtgctaatgaaaaactgcttcaggtgccatttgcagatccatgtcctattctttatatgattttgggaaaggtttttttatttaatattactttgtttcaagccttaataatagttatttaccttcccaaaggtatttcaggtgatttctccccagctgattttcccctgttccctgaaggatagattgcatgatgagatttatttagaggagcagactgccaccctgcatgtatcatgtttgtctattggttggtttctagtccagacacattttattttctgttttaagtgttatgaattattttaatccatggtatgtcttgaatatatataacattattccaagatactaaaaaataaactattctaagaattagaagaaattgtattccgatactgaggttgggtgggatacatgaaaaacctatgataatttttttgtgttcagtgctgtgtaatgtttcaggctgtctccccctgcccttttattattgctgttataaaagactctaataaagtcttaaagatatcagagctcttattttcaaactgtctttagttctccaaattatatatagtccagttaaggggaaaaacctgtctgtaatttatctcattgagtaccagtgtcctgattttgatgggaagtaattcctaacctcttctagggtgtttctcaaataggatgggaaatgtttatctaaactttctagtggtgttaattgcagctgtgggaagagctggaactaaggttatgcagtttggattttttagcatagaattttgaaattgtgagataaacttcatgtattaaagccattacattttttaaaacaagcatgatgtgaaagttaatgtggcctagatctagccttccgaatccttagatcattttacaggaatgagacggagtgatttataggcaaattaatggttctctagagccatgtatcacattgtcgttggttgagaaatccccatcatgactgtgggcctaaaaagtacaggtcattctagtttagagactagtagctttgatgagctggagattgcacttagtaataataatgtttgtataaaattcacagtttatagagtggccttcttgtctcccttaatcctcccaagaacttttggggtataaaaacaccaaaattaagcctgatgagcaaactgtgtgaacaaaacttagcaggagcctaattggtagtgcgtgggttcaagcacacatgctgcatttttccttacctcatactgcctttacacatgaaagttatcggatagtcattggagggaatacatagaaatacactgttctcttctaggatttttaaaaattaaacttcagaagaaaggggttatataaacctcaattcaatggaattcttaaaaacttcttaatttttacgttgaacaaaagttttggtttgtgtaatatttcttaccacctttttccttcaagttgtcagcacatagtaggtgtgttttctttttttgccactggtcttttgtttttttgtttttttgttttttttttggtcattaaatcattttgctctgttgatttttgttcattttgcttggctgcttttgtgggtactacagattaattaaaaggttatttattaacccagtgtctattgctgtaatctttagcatgacaaggccctaactgttgctgcatagttttatgacatgagttattgccctgatcacttttagttttttgtttttttaattgccctccttgtaaatcttatagacgtgtcatgtagtggggtgtaatcggtatatgaacggtagggtagatggtattagattctaatttaaataaatgaatgccttatgtggttgaccttaggactctgcaaaaacttaagcagttcagatgaacaacatgccaactcaaaaacttttattgcttggggcttcctgttttctggaactatgtatactttcatacacattttaactcagcagttttgacaaggacattactatctctgtgtataatttcagaatttccttttaatatttgaggtagagaagaaagagtattattatattctgtgctacaaatggtgattgtacaaaaggaagctgatacttgtttctggccagtacatgaggacactttaaggccctaaatcttaactaaaatgggcagtcttgattcaggatttattttaaatatggaagctttttctttagtgagatgtagactttttttttggatataaatgccagcacctagaccaaagttttgttttgttttgtttttttaagatagggtctctgttgcctaggctggatcttactgcagccttgacctcccagcctcaagcagtccacccacctcagcctcccaagtagctgggactgaaggctcacgccaccatgcccagctaagtttgtttattttttgtagaggcgaggtctcactatattgcccagggtggtctctaactcctaaactcaagcagtcctcccacctcagcctcccaaagtgtaaaccaaactttttattgcatggcttaattgtacccattgaccatgaggaagaagagtccagcaccaggaatggttgtaacacctcctacaggaaaggtactctagttaggagctgcagactttcgtggttttggtcatgctccacgccgaagtcccgaagggaaaggcatggatcctgcctggtctggcagaggcaggagctagggatagaatgcatcttgctttgcagcatacctgtgaaaccaggttttttctgacacctggttagtgaaatactgaaggggaggagagactctagggtttacctccaatattgctgagcaggaaaaaggccttttgcttgtggtaggtaagtaagaggaatggagctgagtaacttgataacgaggcaggaatctgctttatgatgtgaaaacattaccttttaaatgtttgtttggagcaatatcgaagtttaattttaaataatttacaaaaaaaggataaactgtgttaagcaactataatttatagcttatttttattaatcatgtgctcaagtaattaagcttgtgcttcacatgatgttagtgcttgggaccaaaagaaagtgattaaattaattactacccaaattacaggttttagtgctagaactagtacctggatcattttctaattattttaaaatgctatgtcatttgccttttaccttttcttctgggatgttttattcctgcttgagggtattttggggtaagtttgtttacaaacttgttaagacgacctgctagcaaaatcagtacagacttggcaaaaacagacttgtctcctattcacagcattcaagagggggcagaaggaaccctgttttctgtagcatgacatgccatttctgttaggtgtggttttagagcaaatgagacagttactttaccaaaaactaggtacattcagagaacttaggctttaaataccagtttgttgctactcttgcggaagggggaatatttaaagggattcaatatcctgatggtttaaagtaagtggtttacaaattgttctgataatgagtgtctaggcagatctctgaggggacctgaaatctgatgcagctctcctttgttctaggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 256 - RNA, 2243 nt, Homo sapiens
  source 1..2243: mol_type = unassigned RNA; note = Homo sapiens EWS RNA binding protein 1 (EWSR1), transcript variant X25, mRNA, NCBI Reference Sequence: XM_017028659.1
agatttgcgcctgcgcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaaga

SEQ ID NO: 257 - RNA, 2218 nt, Homo sapiens
  source 1..2218: mol_type = unassigned RNA; note = Homo sapiens EWS RNA binding protein 1 (EWSR1), transcript variant X24, mRNA, NCBI Reference Sequence: XM_017028658.1
agagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaaga

SEQ ID NO: 258 - RNA, 2223 nt, Homo sapiens
  source 1..2223: mol_type = unassigned RNA; note = Homo sapiens EWS RNA binding protein 1 (EWSR1), transcript variant X26, mRNA, NCBI Reference Sequence: XM_017028660.2
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagt

SEQ ID NO: 259 - RNA, 6161 nt, Homo sapiens
  source 1..6161: mol_type = unassigned RNA; note = Homo sapiens EWS RNA binding protein 1 (EWSR1), transcript variant X28, mRNA, NCBI Reference Sequence: XM_017028661.2
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactgtagaagggaccagtacaggtttgactatcctgctcattcttgcatgggaaatgctttccatcttgtctaaccctgtaatgttaatcctttaggtgttttcatttgttgaacccccaaactttctaacatcacacacagcaaggtgctaatgaaaaactgcttcaggtgccatttgcagatccatgtcctattctttatatgattttgggaaaggtttttttatttaatattactttgtttcaagccttaataatagttatttaccttcccaaaggtatttcaggtgatttctccccagctgattttcccctgttccctgaaggatagattgcatgatgagatttatttagaggagcagactgccaccctgcatgtatcatgtttgtctattggttggtttctagtccagacacattttattttctgttttaagtgttatgaattattttaatccatggtatgtcttgaatatatataacattattccaagatactaaaaaataaactattctaagaattagaagaaattgtattccgatactgaggttgggtgggatacatgaaaaacctatgataatttttttgtgttcagtgctgtgtaatgtttcaggctgtctccccctgcccttttattattgctgttataaaagactctaataaagtcttaaagatatcagagctcttattttcaaactgtctttagttctccaaattatatatagtccagttaaggggaaaaacctgtctgtaatttatctcattgagtaccagtgtcctgattttgatgggaagtaattcctaacctcttctagggtgtttctcaaataggatgggaaatgtttatctaaactttctagtggtgttaattgcagctgtgggaagagctggaactaaggttatgcagtttggattttttagcatagaattttgaaattgtgagataaacttcatgtattaaagccattacattttttaaaacaagcatgatgtgaaagttaatgtggcctagatctagccttccgaatccttagatcattttacaggaatgagacggagtgatttataggcaaattaatggttctctagagccatgtatcacattgtcgttggttgagaaatccccatcatgactgtgggcctaaaaagtacaggtcattctagtttagagactagtagctttgatgagctggagattgcacttagtaataataatgtttgtataaaattcacagtttatagagtggccttcttgtctcccttaatcctcccaagaacttttggggtataaaaacaccaaaattaagcctgatgagcaaactgtgtgaacaaaacttagcaggagcctaattggtagtgcgtgggttcaagcacacatgctgcatttttccttacctcatactgcctttacacatgaaagttatcggatagtcattggagggaatacatagaaatacactgttctcttctaggatttttaaaaattaaacttcagaagaaaggggttatataaacctcaattcaatggaattcttaaaaacttcttaatttttacgttgaacaaaagttttggtttgtgtaatatttcttaccacctttttccttcaagttgtcagcacatagtaggtgtgttttctttttttgccactggtcttttgtttttttgtttttttgttttttttttggtcattaaatcattttgctctgttgatttttgttcattttgcttggctgcttttgtgggtactacagattaattaaaaggttatttattaacccagtgtctattgctgtaatctttagcatgacaaggccctaactgttgctgcatagttttatgacatgagttattgccctgatcacttttagttttttgtttttttaattgccctccttgtaaatcttatagacgtgtcatgtagtggggtgtaatcggtatatgaacggtagggtagatggtattagattctaatttaaataaatgaatgccttatgtggttgaccttaggactctgcaaaaacttaagcagttcagatgaacaacatgccaactcaaaaacttttattgcttggggcttcctgttttctggaactatgtatactttcatacacattttaactcagcagttttgacaaggacattactatctctgtgtataatttcagaatttccttttaatatttgaggtagagaagaaagagtattattatattctgtgctacaaatggtgattgtacaaaaggaagctgatacttgtttctggccagtacatgaggacactttaaggccctaaatcttaactaaaatgggcagtcttgattcaggatttattttaaatatggaagctttttctttagtgagatgtagactttttttttggatataaatgccagcacctagaccaaagttttgttttgttttgtttttttaagatagggtctctgttgcctaggctggatcttactgcagccttgacctcccagcctcaagcagtccacccacctcagcctcccaagtagctgggactgaaggctcacgccaccatgcccagctaagtttgtttattttttgtagaggcgaggtctcactatattgcccagggtggtctctaactcctaaactcaagcagtcctcccacctcagcctcccaaagtgtaaaccaaactttttattgcatggcttaattgtacccattgaccatgaggaagaagagtccagcaccaggaatggttgtaacacctcctacaggaaaggtactctagttaggagctgcagactttcgtggttttggtcatgctccacgccgaagtcccgaagggaaaggcatggatcctgcctggtctggcagaggcaggagctagggatagaatgcatcttgctttgcagcatacctgtgaaaccaggttttttctgacacctggttagtgaaatactgaaggggaggagagactctagggtttacctccaatattgctgagcaggaaaaaggccttttgcttgtggtaggtaagtaagaggaatggagctgagtaacttgataacgaggcaggaatctgctttatgatgtgaaaacattaccttttaaatgtttgtttggagcaatatcgaagtttaattttaaataatttacaaaaaaaggataaactgtgttaagcaactataatttatagcttatttttattaatcatgtgctcaagtaattaagcttgtgcttcacatgatgttagtgcttgggaccaaaagaaagtgattaaattaattactacccaaattacaggttttagtgctagaactagtacctggatcattttctaattattttaaaatgctatgtcatttgccttttaccttttcttctgggatgttttattcctgcttgagggtattttggggtaagtttgtttacaaacttgttaagacgacctgctagcaaaatcagtacagacttggcaaaaacagacttgtctcctattcacagcattcaagagggggcagaaggaaccctgttttctgtagcatgacatgccatttctgttaggtgtggttttagagcaaatgagacagttactttaccaaaaactaggtacattcagagaacttaggctttaaataccagtttgttgctactcttgcggaagggggaatatttaaagggattcaatatcctgatggtttaaagtaagtggtttacaaattgttctgataatgagtgtctaggcagatctctgaggggacctgaaatctgatgcagctctcctttgttctaggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 260 - RNA, 2007 nt, Homo sapiens
  source 1..2007: mol_type = unassigned RNA; note = Homo sapiens EWS RNA binding protein 1 (EWSR1), transcript variant X29, mRNA, NCBI Reference Sequence: XM_017028662.2
agatttgcgcctgcgcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 261 - RNA, 2121 nt, Homo sapiens
  source 1..2121: mol_type = unassigned RNA; note = Homo sapiens EWS RNA binding protein 1 (EWSR1), transcript variant X32, mRNA, NCBI Reference Sequence: XM_017028663.1
agatttgcgcctgcgcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 262 - RNA, 2388 nt, Homo sapiens
  source 1..2388: mol_type = unassigned RNA; note = Homo sapiens EWS RNA binding protein 1 (EWSR1), transcript variant X33, mRNA, NCBI Reference Sequence: XM_017028664.2
agagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 263 - RNA, 2348 nt, Homo sapiens
  source 1..2348: mol_type = unassigned RNA; note = Homo sapiens EWS RNA binding protein 1 (EWSR1), transcript variant X35, mRNA, NCBI Reference Sequence: XM_017028665.2
agagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaaga

SEQ ID NO: 264 - RNA, 6125 nt, Homo sapiens
  source 1..6125: mol_type = unassigned RNA; note = Homo sapiens EWS RNA binding protein 1 (EWSR1), transcript variant X36, mRNA, NCBI Reference Sequence: XM_017028666.2
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactgtagaagggaccagtacaggtttgactatcctgctcattcttgcatgggaaatgctttccatcttgtctaaccctgtaatgttaatcctttaggtgttttcatttgttgaacccccaaactttctaacatcacacacagcaaggtgctaatgaaaaactgcttcaggtgccatttgcagatccatgtcctattctttatatgattttgggaaaggtttttttatttaatattactttgtttcaagccttaataatagttatttaccttcccaaaggtatttcaggtgatttctccccagctgattttcccctgttccctgaaggatagattgcatgatgagatttatttagaggagcagactgccaccctgcatgtatcatgtttgtctattggttggtttctagtccagacacattttattttctgttttaagtgttatgaattattttaatccatggtatgtcttgaatatatataacattattccaagatactaaaaaataaactattctaagaattagaagaaattgtattccgatactgaggttgggtgggatacatgaaaaacctatgataatttttttgtgttcagtgctgtgtaatgtttcaggctgtctccccctgcccttttattattgctgttataaaagactctaataaagtcttaaagatatcagagctcttattttcaaactgtctttagttctccaaattatatatagtccagttaaggggaaaaacctgtctgtaatttatctcattgagtaccagtgtcctgattttgatgggaagtaattcctaacctcttctagggtgtttctcaaataggatgggaaatgtttatctaaactttctagtggtgttaattgcagctgtgggaagagctggaactaaggttatgcagtttggattttttagcatagaattttgaaattgtgagataaacttcatgtattaaagccattacattttttaaaacaagcatgatgtgaaagttaatgtggcctagatctagccttccgaatccttagatcattttacaggaatgagacggagtgatttataggcaaattaatggttctctagagccatgtatcacattgtcgttggttgagaaatccccatcatgactgtgggcctaaaaagtacaggtcattctagtttagagactagtagctttgatgagctggagattgcacttagtaataataatgtttgtataaaattcacagtttatagagtggccttcttgtctcccttaatcctcccaagaacttttggggtataaaaacaccaaaattaagcctgatgagcaaactgtgtgaacaaaacttagcaggagcctaattggtagtgcgtgggttcaagcacacatgctgcatttttccttacctcatactgcctttacacatgaaagttatcggatagtcattggagggaatacatagaaatacactgttctcttctaggatttttaaaaattaaacttcagaagaaaggggttatataaacctcaattcaatggaattcttaaaaacttcttaatttttacgttgaacaaaagttttggtttgtgtaatatttcttaccacctttttccttcaagttgtcagcacatagtaggtgtgttttctttttttgccactggtcttttgtttttttgtttttttgttttttttttggtcattaaatcattttgctctgttgatttttgttcattttgcttggctgcttttgtgggtactacagattaattaaaaggttatttattaacccagtgtctattgctgtaatctttagcatgacaaggccctaactgttgctgcatagttttatgacatgagttattgccctgatcacttttagttttttgtttttttaattgccctccttgtaaatcttatagacgtgtcatgtagtggggtgtaatcggtatatgaacggtagggtagatggtattagattctaatttaaataaatgaatgccttatgtggttgaccttaggactctgcaaaaacttaagcagttcagatgaacaacatgccaactcaaaaacttttattgcttggggcttcctgttttctggaactatgtatactttcatacacattttaactcagcagttttgacaaggacattactatctctgtgtataatttcagaatttccttttaatatttgaggtagagaagaaagagtattattatattctgtgctacaaatggtgattgtacaaaaggaagctgatacttgtttctggccagtacatgaggacactttaaggccctaaatcttaactaaaatgggcagtcttgattcaggatttattttaaatatggaagctttttctttagtgagatgtagactttttttttggatataaatgccagcacctagaccaaagttttgttttgttttgtttttttaagatagggtctctgttgcctaggctggatcttactgcagccttgacctcccagcctcaagcagtccacccacctcagcctcccaagtagctgggactgaaggctcacgccaccatgcccagctaagtttgtttattttttgtagaggcgaggtctcactatattgcccagggtggtctctaactcctaaactcaagcagtcctcccacctcagcctcccaaagtgtaaaccaaactttttattgcatggcttaattgtacccattgaccatgaggaagaagagtccagcaccaggaatggttgtaacacctcctacaggaaaggtactctagttaggagctgcagactttcgtggttttggtcatgctccacgccgaagtcccgaagggaaaggcatggatcctgcctggtctggcagaggcaggagctagggatagaatgcatcttgctttgcagcatacctgtgaaaccaggttttttctgacacctggttagtgaaatactgaaggggaggagagactctagggtttacctccaatattgctgagcaggaaaaaggccttttgcttgtggtaggtaagtaagaggaatggagctgagtaacttgataacgaggcaggaatctgctttatgatgtgaaaacattaccttttaaatgtttgtttggagcaatatcgaagtttaattttaaataatttacaaaaaaaggataaactgtgttaagcaactataatttatagcttatttttattaatcatgtgctcaagtaattaagcttgtgcttcacatgatgttagtgcttgggaccaaaagaaagtgattaaattaattactacccaaattacaggttttagtgctagaactagtacctggatcattttctaattattttaaaatgctatgtcatttgccttttaccttttcttctgggatgttttattcctgcttgagggtattttggggtaagtttgtttacaaacttgttaagacgacctgctagcaaaatcagtacagacttggcaaaaacagacttgtctcctattcacagcattcaagagggggcagaaggaaccctgttttctgtagcatgacatgccatttctgttaggtgtggttttagagcaaatgagacagttactttaccaaaaactaggtacattcagagaacttaggctttaaataccagtttgttgctactcttgcggaagggggaatatttaaagggattcaatatcctgatggtttaaagtaagtggtttacaaattgttctgataatgagtgtctaggcagatctctgaggggacctgaaatctgatgcagctctcctttgttctaggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaaga

SEQ ID NO: 265 - RNA, 2156 nt, Homo sapiens
  source 1..2156: mol_type = unassigned RNA; note = Homo sapiens EWS RNA binding protein 1 (EWSR1), transcript variant X30, mRNA, NCBI Reference Sequence: XM_024452180.1
ggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagt

SEQ ID NO: 266 - RNA, 2130 nt, Homo sapiens
  source 1..2130: mol_type = unassigned RNA; note = Homo sapiens EWS RNA binding protein 1 (EWSR1), transcript variant X31, mRNA, NCBI Reference Sequence: XM_024452181.1
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagt

SEQ ID NO: 267 - RNA, 3819 nt, Homo sapiens
  source 1..3819: mol_type = unassigned RNA; note = Homo sapiens EWS RNA binding protein 1 (EWSR1), transcript variant X34, misc_RNA, NCBI Reference Sequence: XR_002958676.1
agtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatggtgagatgtactcactggcattcttaatctccctggctatagaatatggcatgagggagaaacttgtgaaccataggagcaagaagaccttccatctcttcctgggggaggtagatggccggtctccctgcagtagtagtagcacccagccattgaccctggatttggagatccctttattttgaggcattagtattacaaatcaaccttgcttaaagtggcaaacacttcctaagcacagattatcagaaggtacagaaaacccttcaaaagaacatcttagccagtgtacatttgcatatagataaatatatatatttaaatgaggccttgacattaatggtgggatttcacttcagacaaaaccaacttgaaagcattgaatgacttggccatgtccagtggcttgcacctgtaatcccagcactttgggaggccaacatcggtgcattgcttgaatccaggggcttgagaccagcctggggaacatggcaaaaccctgtctctacaaaaaaaatacaaaaattagccaggtgttgtggcacactcctatacctatagtaccagccactcaggaggctgaggtgggaggatcacttgagcccggagagtttgaagctccagtgagctgagattgcaccactgcactccaacctgggcaacggagcaagactctgtctcaaagaaagtgtcaaataacaagtcctggttctgttttcttggtcatgcagtcagcttcccaccagcttattttcctccttatggtagacagtgttttttgcttgtgttgttttttttgagatggtctcactttgtcacccaggctggagtgcagtgacacaagccatctcagcttactgcaacctccacctcccaggttcaagccaatcttgtgcgtcagccactcgagtagctgctggactacaggcgcatgtcaccacgctgagcctaacttttgtattttttagtagagatggggtttcaccatgttggtcaggctgtaggaaggtttttaagtgtatttaagtatggcctttttctggccaggcacagtggctcttgcctataatcctaccacttcaggaggccaaggcaggaggattgtttgaaccaaggagttcactagcagcctgggcaacctagtgagacactgcctctacaaacaattttgtaaaattagtcgggcatggtgatgcgtgcctgtagtcccagctacttgggaggattgcttgagcaagtgagattgaaactgcagtgagctgtgccactgcactccagcccgggcaacagagtgagactcccatctcaaaaaaagcctttttctggccttgtcattaaagatcttagagaagattacaggcagacctaatgcatctgggagtggtcatttgatgatgatgtggagttggtgaacagggagtacaggggagtaattgatgttctgttgtcttgttccagggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 268 - RNA, 4921 nt, Homo sapiens
  source 1..4921: mol_type = unassigned RNA; note = Homo sapiens signal transducer and activator of transcription 3 (STAT3), transcript variant 1, mRNA, NCBI Reference Sequence: NM_139276.3
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 269 - RNA, 4896 nt, Homo sapiens
  source 1..4896: mol_type = unassigned RNA; note = Homo sapiens signal transducer and activator of transcription 3 (STAT3), transcript variant 2, mRNA, NCBI Reference Sequence: NM_003150.4
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 270 - RNA, 4871 nt, Homo sapiens
  source 1..4871: mol_type = unassigned RNA; note = Homo sapiens signal transducer and activator of transcription 3 (STAT3), transcript variant 3, mRNA, NCBI Reference Sequence: NM_213662.2
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 271 - RNA, 4899 nt, Homo sapiens
  source 1..4899: mol_type = unassigned RNA; note = Homo sapiens signal transducer and activator of transcription 3 (STAT3), transcript variant 4, mRNA, NCBI Reference Sequence: NM_001369512.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 272 - RNA, 4902 nt, Homo sapiens
  source 1..4902: mol_type = unassigned RNA; note = Homo sapiens signal transducer and activator of transcription 3 (STAT3), transcript variant 5, mRNA, NCBI Reference Sequence: NM_001369513.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 273 - RNA, 4899 nt, Homo sapiens
  source 1..4899: mol_type = unassigned RNA; note = Homo sapiens signal transducer and activator of transcription 3 (STAT3), transcript variant 6, mRNA, NCBI Reference Sequence: NM_001369514.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 274 - RNA, 4918 nt, Homo sapiens
  source 1..4918: mol_type = unassigned RNA; note = Homo sapiens signal transducer and activator of transcription 3 (STAT3), transcript variant 7, mRNA, NCBI Reference Sequence: NM_001369516.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 275 - RNA, 4849 nt, Homo sapiens
  source 1..4849: mol_type = unassigned RNA; note = Homo sapiens signal transducer and activator of transcription 3 (STAT3), transcript variant 8, mRNA, NCBI Reference Sequence: NM_001369517.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 276 - RNA, 4852 nt, Homo sapiens
  source 1..4852: mol_type = unassigned RNA; note = Homo sapiens signal transducer and activator of transcription 3 (STAT3), transcript variant 9, mRNA, NCBI Reference Sequence: NM_001369518.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 277 - RNA, 4846 nt, Homo sapiens
  source 1..4846: mol_type = unassigned RNA; note = Homo sapiens signal transducer and activator of transcription 3 (STAT3), transcript variant 10, mRNA, NCBI Reference Sequence: NM_001369519.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 278 - RNA, 4868 nt, Homo sapiens
  source 1..4868: mol_type = unassigned RNA; note = Homo sapiens signal transducer and activator of transcription 3 (STAT3), transcript variant 11, mRNA, NCBI Reference Sequence: NM_001369520.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 279 - RNA, 4815 nt, Homo sapiens
  source 1..4815: mol_type = unassigned RNA; note = Homo sapiens signal transducer and activator of transcription 3 (STAT3), transcript variant 12, mRNA, NCBI Reference Sequence: NM_001384984.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 280 - RNA, 4843 nt, Homo sapiens
  source 1..4843: mol_type = unassigned RNA; note = Homo sapiens signal transducer and activator of transcription 3 (STAT3), transcript variant 13, mRNA, NCBI Reference Sequence: NM_001384985.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 281 - RNA, 4883 nt, Homo sapiens
  source 1..4883: mol_type = unassigned RNA; note = Homo sapiens signal transducer and activator of transcription 3 (STAT3), transcript variant 14, mRNA, NCBI Reference Sequence: NM_001384986.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaatctgtgttcttacagagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 282 - RNA, 4900 nt, Homo sapiens
  source 1..4900: mol_type = unassigned RNA; note = Homo sapiens signal transducer and activator of transcription 3 (STAT3), transcript variant 15, mRNA, NCBI Reference Sequence: NM_001384987.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 283 - RNA, 4825 nt, Homo sapiens
  source 1..4825: mol_type = unassigned RNA; note = Homo sapiens signal transducer and activator of transcription 3 (STAT3), transcript variant 16, mRNANCBI Reference Sequence: NM_001384988.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 284 - RNA, 4800 nt, Homo sapiens
  source 1..4800: mol_type = unassigned RNA; note = Homo sapiens signal transducer and activator of transcription 3 (STAT3), transcript variant 17, mRNA, NCBI Reference Sequence: NM_001384989.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 285 - RNA, 4886 nt, Homo sapiens
  source 1..4886: mol_type = unassigned RNA; note = Homo sapiens signal transducer and activator of transcription 3 (STAT3), transcript variant 18, mRNA, NCBI Reference Sequence: NM_001384990.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaatctgtgttcttacagagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 286 - RNA, 4894 nt, Homo sapiens
  source 1..4894: mol_type = unassigned RNA; note = Homo sapiens signal transducer and activator of transcription 3 (STAT3), transcript variant 19, mRNA, NCBI Reference Sequence: NM_001384991.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 287 - RNA, 4839 nt, Homo sapiens
  source 1..4839: mol_type = unassigned RNA; note = Homo sapiens signal transducer and activator of transcription 3 (STAT3), transcript variant 20, mRNA, NCBI Reference Sequence: NM_001384992.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcagagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 288 - RNA, 4909 nt, Homo sapiens
  source 1..4909: mol_type = unassigned RNA; note = Homo sapiens signal transducer and activator of transcription 3 (STAT3), transcript variant 21, mRNA, NCBI Reference Sequence: NM_001384993.1
gtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacacccaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 289 - RNA, 4909 nt, Homo sapiens
  source 1..4909: mol_type = unassigned RNA; note = Homo sapiens signal transducer and activator of transcription 3 (STAT3), transcript variant X6, mRNA, NCBI Reference Sequence: XM_017024973.2
attcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 290 - RNA, 3499 nt, Homo sapiens
  source 1..3499: mol_type = unassigned RNA; note = Homo sapiens signal transducer and activator of transcription 3 (STAT3), transcript variant X8, mRNA, NCBI Reference Sequence: XM_024450896.1
gcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttggtatgtgggaggagctccccttcacaaagggcctctggctgccggagagggctagggagagcctcacaggacacctgcctttttcttttcttacagaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtc

SEQ ID NO: 291 - RNA, 1630 nt, Homo sapiens
  source 1..1630: mol_type = unassigned RNA; note = Homo sapiens twist family bHLH transcription factor 1 (TWIST1), transcript variant 1, mRNA, NCBI Reference Sequence: NM_000474.4
aactcccagacacctcgcgggctctgcagcaccggcaccgtttccaggaggcctggcggggtgtgcgtccagccgttgggcgctttctttttggacctcggggccatccacaccgtcccctccccctcccgcctccctccccgcctcccccgcgcgccctccccgcggaggtccctcccgtccgtcctcctgctctctcctccgcgggccgcatcgcccgggccggcgccgcgcgcgggggaagctggcgggctgaggcgccccgctcttctcctctgccccgggcccgcgaggccacgcgtcgccgctcgagagatgatgcaggacgtgtccagctcgccagtctcgccggccgacgacagcctgagcaacagcgaggaagagccagaccggcagcagccgccgagcggcaagcgcgggggacgcaagcggcgcagcagcaggcgcagcgcgggcggcggcgcggggcccggcggagccgcgggtgggggcgtcggaggcggcgacgagccgggcagcccggcccagggcaagcgcggcaagaagtctgcgggctgtggcggcggcggcggcgcgggcggcggcggcggcagcagcagcggcggcgggagtccgcagtcttacgaggagctgcagacgcagcgggtcatggccaacgtgcgggagcgccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatgtcattgtttccagagaaggagaaaatggacagtctagagactctggagctggataactaaaaataaaaatatatgccaaagattttcttggaaattagaagagcaaaatccaaattcaaagaaacagggcgtggggcgcacttttaaaagagaaagcgagacaggcccgtggacagtgattcccagacgggcagcggcaccatcctcacacctctgcattctgatagaagtctgaacagttgtttgtgttttttttttttttttttttgacgaagaatgtttttatttttatttttttcatgcatgcattctcaagaggtcgtgccaatcagccactgaaaggaaaggcatcactatggactttctctattttaaaatggtaacaatcagaggaactataagaacacctttagaaataaaaatactgggatcaaactggcctgcaaaaccatagtcagttaattctttttttcatccttcctctgaggggaaaaacaaaaaaaaacttaaaatacaaaaaacaacattctatttatttattgaggacccatggtaaaatgcaaatagatccggtgtctaaatgcattcatatttttatgattgttttgtaaatatctttgtatatttttctgcaataaataaatataaaaaatttagagaa

SEQ ID NO: 292 - RNA, 1107 nt, Homo sapiens
  source 1..1107: mol_type = unassigned RNA; note = Homo sapiens twist family bHLH transcription factor 1 (TWIST1), transcript variant 2, non-coding RNA, NCBI Reference Sequence: NR_149001.2
aactcccagacacctcgcgggctctgcagcaccggcaccgtttccaggaggcctggcggggtgtgcgtccagccgttgggcgctttctttttggacctcggggccatccacaccgtcccctccccctcccgcctccctccccgcctcccccgcgcgccctccccgcggaggtccctcccgtccgtcctcctgctctctcctccgcgggccgcatcgcccgggccggcgccgcgcgcgggggaagctggcgggctgaggcgccccgctcttctcctctgccccgggcccgcgaggccacgcgtcgccgctcgagagatgatgcaggacgtgtccagctcgccagtctcgccggccgacgacagcctgagcaacagcgaggaagagccagaccggcagcagccgccgagcggcaagcgcgggggacgcaagcggcgcagcagcaggcgcagcgcgggcggcggcgcggggcccggcggagccgcgggtgggggcgtcggaggcggcgacgagccgggcagcccggcccagggcaagcgcggcaagaagtctgcgggctgtggcggcggcggcggcgcgggcggcggcggcggcagcagcagcggcggcgggagtccgcagtcttacgaggagctgcagacgcagcgggtcatggccaacgtgcgggagcgccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatttcttaaggtacaccaggatggagctggccatgactgctgagaagaagcacatgtccagatgataattcacgcacagttacaggttcccctccccaaagtggaacgtattattaataaaataatgttaaggagcagaaa

SEQ ID NO: 293 - RNA, 4110 nt, Homo sapiens
  source 1..4110: mol_type = unassigned RNA; note = Homo sapiens folate hydrolase 1 (FOLH1), transcript variant 1, mRNA, NCBI Reference Sequence: NM_004476.3
agtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatatagttatgtgagtgtttatatatgtgtgtgtttatattgtttatcttctccctatggattaaaactgaatttcataattataagaggttattctgaagtggaaaaatttaactcagtattaaatctaaggagaatggcctaatatagtaaaactctcatctggcattatcagggaatcaagtctaatctattcatgtcacttcacacagaagaaaacatcagtatgtcagagagcacactggggaatatgcacaagattatcccaagccagaggcctcacggcctacctggccagcctgggctgagaggatcactatctcagcacactatttgggaaatggatcaaatcacacttttagtaaatgttatcactctatagcataagaaataattattttttatttatataaaaggctatagtataaaatatatgtatagtaattaaatgaacacttgtgaacctaatagccatatgaagaaaataacatttctaatatctttggatgccccatgtactaatgacagttatgcttttgcattttcttgaattttatgtttatttatctttcctctgtcattatttataattttatcacacatggctgtatcctttacatgttttggcattatgtatttttgaactttttgtaaagacaatcataccatgtgtaattttcagggacttgatttttttcattgacttttaagggttcaaatatattatcactgtggctgtagtttgccatattttgctgatatagagcattcattcacatgagggtaggattcagggtccatcaagacagagaaaacatacagtaatgtgaatagggaaagttaatatgaagaattattaattgttacagcattggaacaatgaaatattgtctagtaatatgtaaagagaagtctcaagaatatgtgatgagcagatgtaaggaattgctcttgtctccatggtgaatttggagcagccaatgaagagtcccctcacattgtggcctcgctcaaagttaagaagtcgctgtagtgttgcccttgaagaatctgcttcaaattgacacttcagaactccccagaaacttgtcttctgggccaatgtgtaaagctgtttatgaagaaatgtcaagccagaggggctctactacaaatttggcaaaggacaatttcaggagaagctcttggccgctgggttctcctggccaccatgaacttcaggaagtgggtgccatagcagcagcctgaactacagaatctgggcactggtgtagctctgtatgccctccgtgtcagatgctggagatgtcatttgcattgccagagtttgccaagggtgcacacagaaagcagattgaaaagcaccctcttggaacatctctccaatgccttctactcacaaagtttaacatcattaacacgtgacaaagaagaactatttaatgggcccagatctatttatgaagacaatcaagtgggagtttggagtggataacccaaatttggataactggtgaataataaaatgtatttatttctgctggtgta

SEQ ID NO: 294 - RNA, 4017 nt, Homo sapiens
  source 1..4017: mol_type = unassigned RNA; note = Homo sapiens folate hydrolase 1 (FOLH1), transcript variant 2, mRNA, NCBI Reference Sequence: NM_001014986.3
agtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatatagttatgtgagtgtttatatatgtgtgtgtttatattgtttatcttctccctatggattaaaactgaatttcataattataagaggttattctgaagtggaaaaatttaactcagtattaaatctaaggagaatggcctaatatagtaaaactctcatctggcattatcagggaatcaagtctaatctattcatgtcacttcacacagaagaaaacatcagtatgtcagagagcacactggggaatatgcacaagattatcccaagccagaggcctcacggcctacctggccagcctgggctgagaggatcactatctcagcacactatttgggaaatggatcaaatcacacttttagtaaatgttatcactctatagcataagaaataattattttttatttatataaaaggctatagtataaaatatatgtatagtaattaaatgaacacttgtgaacctaatagccatatgaagaaaataacatttctaatatctttggatgccccatgtactaatgacagttatgcttttgcattttcttgaattttatgtttatttatctttcctctgtcattatttataattttatcacacatggctgtatcctttacatgttttggcattatgtatttttgaactttttgtaaagacaatcataccatgtgtaattttcagggacttgatttttttcattgacttttaagggttcaaatatattatcactgtggctgtagtttgccatattttgctgatatagagcattcattcacatgagggtaggattcagggtccatcaagacagagaaaacatacagtaatgtgaatagggaaagttaatatgaagaattattaattgttacagcattggaacaatgaaatattgtctagtaatatgtaaagagaagtctcaagaatatgtgatgagcagatgtaaggaattgctcttgtctccatggtgaatttggagcagccaatgaagagtcccctcacattgtggcctcgctcaaagttaagaagtcgctgtagtgttgcccttgaagaatctgcttcaaattgacacttcagaactccccagaaacttgtcttctgggccaatgtgtaaagctgtttatgaagaaatgtcaagccagaggggctctactacaaatttggcaaaggacaatttcaggagaagctcttggccgctgggttctcctggccaccatgaacttcaggaagtgggtgccatagcagcagcctgaactacagaatctgggcactggtgtagctctgtatgccctccgtgtcagatgctggagatgtcatttgcattgccagagtttgccaagggtgcacacagaaagcagattgaaaagcaccctcttggaacatctctccaatgccttctactcacaaagtttaacatcattaacacgtgacaaagaagaactatttaatgggcccagatctatttatgaagacaatcaagtgggagtttggagtggataacccaaatttggataactggtgaataataaaatgtatttatttctgctggtgta

SEQ ID NO: 295 - RNA, 4207 nt, Homo sapiens
  source 1..4207: mol_type = unassigned RNA; note = Homo sapiens folate hydrolase 1 (FOLH1), transcript variant 3, mRNA, NCBI Reference Sequence: NM_001193471.3
agtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatatagttatgtgagtgtttatatatgtgtgtgtttatattgtttatcttctccctatggattaaaactgaatttcataattataagaggttattctgaagtggaaaaatttaactcagtattaaatctaaggagaatggcctaatatagtaaaactctcatctggcattatcagggaatcaagtctaatctattcatgtcacttcacacagaagaaaacatcagtatgtcagagagcacactggggaatatgcacaagattatcccaagccagaggcctcacggcctacctggccagcctgggctgagaggatcactatctcagcacactatttgggaaatggatcaaatcacacttttagtaaatgttatcactctatagcataagaaataattattttttatttatataaaaggctatagtataaaatatatgtatagtaattaaatgaacacttgtgaacctaatagccatatgaagaaaataacatttctaatatctttggatgccccatgtactaatgacagttatgcttttgcattttcttgaattttatgtttatttatctttcctctgtcattatttataattttatcacacatggctgtatcctttacatgttttggcattatgtatttttgaactttttgtaaagacaatcataccatgtgtaattttcagggacttgatttttttcattgacttttaagggttcaaatatattatcactgtggctgtagtttgccatattttgctgatatagagcattcattcacatgagggtaggattcagggtccatcaagacagagaaaacatacagtaatgtgaatagggaaagttaatatgaagaattattaattgttacagcattggaacaatgaaatattgtctagtaatatgtaaagagaagtctcaagaatatgtgatgagcagatgtaaggaattgctcttgtctccatggtgaatttggagcagccaatgaagagtcccctcacattgtggcctcgctcaaagttaagaagtcgctgtagtgttgcccttgaagaatctgcttcaaattgacacttcagaactccccagaaacttgtcttctgggccaatgtgtaaagctgtttatgaagaaatgtcaagccagaggggctctactacaaatttggcaaaggacaatttcaggagaagctcttggccgctgggttctcctggccaccatgaacttcaggaagtgggtgccatagcagcagcctgaactacagaatctgggcactggtgtagctctgtatgccctccgtgtcagatgctggagatgtcatttgcattgccagagtttgccaagggtgcacacagaaagcagattgaaaagcaccctcttggaacatctctccaatgccttctactcacaaagtttaacatcattaacacgtgacaaagaagaactatttaatgggcccagatctatttatgaagacaatcaagtgggagtttggagtggataacccaaatttggataactggtgaataataaaatgtatttatttctgctggtgta

SEQ ID NO: 296 - RNA, 4114 nt, Homo sapiens
  source 1..4114: mol_type = unassigned RNA; note = Homo sapiens folate hydrolase 1 (FOLH1), transcript variant 4, mRNA, NCBI Reference Sequence: NM_001193472.3
agtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatatagttatgtgagtgtttatatatgtgtgtgtttatattgtttatcttctccctatggattaaaactgaatttcataattataagaggttattctgaagtggaaaaatttaactcagtattaaatctaaggagaatggcctaatatagtaaaactctcatctggcattatcagggaatcaagtctaatctattcatgtcacttcacacagaagaaaacatcagtatgtcagagagcacactggggaatatgcacaagattatcccaagccagaggcctcacggcctacctggccagcctgggctgagaggatcactatctcagcacactatttgggaaatggatcaaatcacacttttagtaaatgttatcactctatagcataagaaataattattttttatttatataaaaggctatagtataaaatatatgtatagtaattaaatgaacacttgtgaacctaatagccatatgaagaaaataacatttctaatatctttggatgccccatgtactaatgacagttatgcttttgcattttcttgaattttatgtttatttatctttcctctgtcattatttataattttatcacacatggctgtatcctttacatgttttggcattatgtatttttgaactttttgtaaagacaatcataccatgtgtaattttcagggacttgatttttttcattgacttttaagggttcaaatatattatcactgtggctgtagtttgccatattttgctgatatagagcattcattcacatgagggtaggattcagggtccatcaagacagagaaaacatacagtaatgtgaatagggaaagttaatatgaagaattattaattgttacagcattggaacaatgaaatattgtctagtaatatgtaaagagaagtctcaagaatatgtgatgagcagatgtaaggaattgctcttgtctccatggtgaatttggagcagccaatgaagagtcccctcacattgtggcctcgctcaaagttaagaagtcgctgtagtgttgcccttgaagaatctgcttcaaattgacacttcagaactccccagaaacttgtcttctgggccaatgtgtaaagctgtttatgaagaaatgtcaagccagaggggctctactacaaatttggcaaaggacaatttcaggagaagctcttggccgctgggttctcctggccaccatgaacttcaggaagtgggtgccatagcagcagcctgaactacagaatctgggcactggtgtagctctgtatgccctccgtgtcagatgctggagatgtcatttgcattgccagagtttgccaagggtgcacacagaaagcagattgaaaagcaccctcttggaacatctctccaatgccttctactcacaaagtttaacatcattaacacgtgacaaagaagaactatttaatgggcccagatctatttatgaagacaatcaagtgggagtttggagtggataacccaaatttggataactggtgaataataaaatgtatttatttctgctggtgta

SEQ ID NO: 297 - RNA, 3736 nt, Homo sapiens
  source 1..3736: mol_type = unassigned RNA; note = Homo sapiens folate hydrolase 1 (FOLH1), transcript variant 5, mRNA, NCBI Reference Sequence: NM_001193473.3
agtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttataattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatatagttatgtgagtgtttatatatgtgtgtgtttatattgtttatcttctccctatggattaaaactgaatttcataattataagaggttattctgaagtggaaaaatttaactcagtattaaatctaaggagaatggcctaatatagtaaaactctcatctggcattatcagggaatcaagtctaatctattcatgtcacttcacacagaagaaaacatcagtatgtcagagagcacactggggaatatgcacaagattatcccaagccagaggcctcacggcctacctggccagcctgggctgagaggatcactatctcagcacactatttgggaaatggatcaaatcacacttttagtaaatgttatcactctatagcataagaaataattattttttatttatataaaaggctatagtataaaatatatgtatagtaattaaatgaacacttgtgaacctaatagccatatgaagaaaataacatttctaatatctttggatgccccatgtactaatgacagttatgcttttgcattttcttgaattttatgtttatttatctttcctctgtcattatttataattttatcacacatggctgtatcctttacatgttttggcattatgtatttttgaactttttgtaaagacaatcataccatgtgtaattttcagggacttgatttttttcattgacttttaagggttcaaatatattatcactgtggctgtagtttgccatattttgctgatatagagcattcattcacatgagggtaggattcagggtccatcaagacagagaaaacatacagtaatgtgaatagggaaagttaatatgaagaattattaattgttacagcattggaacaatgaaatattgtctagtaatatgtaaagagaagtctcaagaatatgtgatgagcagatgtaaggaattgctcttgtctccatggtgaatttggagcagccaatgaagagtcccctcacattgtggcctcgctcaaagttaagaagtcgctgtagtgttgcccttgaagaatctgcttcaaattgacacttcagaactccccagaaacttgtcttctgggccaatgtgtaaagctgtttatgaagaaatgtcaagccagaggggctctactacaaatttggcaaaggacaatttcaggagaagctcttggccgctgggttctcctggccaccatgaacttcaggaagtgggtgccatagcagcagcctgaactacagaatctgggcactggtgtagctctgtatgccctccgtgtcagatgctggagatgtcatttgcattgccagagtttgccaagggtgcacacagaaagcagattgaaaagcaccctcttggaacatctctccaatgccttctactcacaaagtttaacatcattaacacgtgacaaagaagaactatttaatgggcccagatctatttatgaagacaatcaagtgggagtttggagtggataacccaaatttggataactggtgaataataaaatgtatttatttctgctggtgta

SEQ ID NO: 298 - RNA, 3883 nt, Homo sapiens
  source 1..3883: mol_type = unassigned RNA; note = Homo sapiens folate hydrolase 1 (FOLH1), transcript variant 6, mRNA, NCBI Reference Sequence: NM_001351236.2
agtgcactctagaaacactgctgtggtggagaaactggaccccagaggcaagcttgggaactgtgtgaaccaggtcagcaatctggacaggtctttaccagcgggtcttttgctgtttttcctgggtactgatttgcagacttgatccaactttctaagaaaagcagaaccacacagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatatagttatgtgagtgtttatatatgtgtgtgtttatattgtttatcttctccctatggattaaaactgaatttcataattataagaggttattctgaagtggaaaaatttaactcagtattaaatctaaggagaatggcctaatatagtaaaactctcatctggcattatcagggaatcaagtctaatctattcatgtcacttcacacagaagaaaacatcagtatgtcagagagcacactggggaatatgcacaagattatcccaagccagaggcctcacggcctacctggccagcctgggctgagaggatcactatctcagcacactatttgggaaatggatcaaatcacacttttagtaaatgttatcactctatagcataagaaataattattttttatttatataaaaggctatagtataaaatatatgtatagtaattaaatgaacacttgtgaacctaatagccatatgaagaaaataacatttctaatatctttggatgccccatgtactaatgacagttatgcttttgcattttcttgaattttatgtttatttatctttcctctgtcattatttataattttatcacacatggctgtatcctttacatgttttggcattatgtatttttgaactttttgtaaagacaatcataccatgtgtaattttcagggacttgatttttttcattgacttttaagggttcaaatatattatcactgtggctgtagtttgccatattttgctgatatagagcattcattcacatgagggtaggattcagggtccatcaagacagagaaaacatacagtaatgtgaatagggaaagttaatatgaagaattattaattgttacagcattggaacaatgaaatattgtctagtaatatgtaaagagaagtctcaagaatatgtgatgagcagatgtaaggaattgctcttgtctccatggtgaatttggagcagccaatgaagagtcccctcacattgtggcctcgctcaaagttaagaagtcgctgtagtgttgcccttgaagaatctgcttcaaattgacacttcagaactccccagaaacttgtcttctgggccaatgtgtaaagctgtttatgaagaaatgtcaagccagaggggctctactacaaatttggcaaaggacaatttcaggagaagctcttggccgctgggttctcctggccaccatgaacttcaggaagtgggtgccatagcagcagcctgaactacagaatctgggcactggtgtagctctgtatgccctccgtgtcagatgctggagatgtcatttgcattgccagagtttgccaagggtgcacacagaaagcagattgaaaagcaccctcttggaacatctctccaatgccttctactcacaaagtttaacatcattaacacgtgacaaagaagaactatttaatgggcccagatctatttatgaagacaatcaagtgggagtttggagtggataacccaaatttggataactggtgaataataaaatgtatttatttctgctggtgta

SEQ ID NO: 299 - RNA, 1930 nt, Homo sapiens
  source 1..1930: mol_type = unassigned RNA; note = Homo sapiens folate hydrolase 1 (FOLH1), transcript variant X6, mRNA, NCBI Reference Sequence: XM_011519958.3
ggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggtaggggggcgcctcgcggagcaaacctcggagtcttccccgtggtgccgcggtgctgggactcgcgggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagaggataagcaaattgggatctggaaatgattttgaggtgttcttccaacgacttggaattgcttcaggcagagcacggtatactaaaaattgggtaa

SEQ ID NO: 300 - RNA, 4308 nt, Homo sapiens
  source 1..4308: mol_type = unassigned RNA; note = Homo sapiens folate hydrolase 1 (FOLH1), transcript variant X1, mRNA, NCBI Reference Sequence: XM_017017432.1
cagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggtaggggggcgcctcgcggagcaaacctcggagtcttccccgtggtgccgcggtgctgggactcgcgggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatatagttatgtgagtgtttatatatgtgtgtgtttatattgtttatcttctccctatggattaaaactgaatttcataattataagaggttattctgaagtggaaaaatttaactcagtattaaatctaaggagaatggcctaatatagtaaaactctcatctggcattatcagggaatcaagtctaatctattcatgtcacttcacacagaagaaaacatcagtatgtcagagagcacactggggaatatgcacaagattatcccaagccagaggcctcacggcctacctggccagcctgggctgagaggatcactatctcagcacactatttgggaaatggatcaaatcacacttttagtaaatgttatcactctatagcataagaaataattattttttatttatataaaaggctatagtataaaatatatgtatagtaattaaatgaacacttgtgaacctaatagccatatgaagaaaataacatttctaatatctttggatgccccatgtactaatgacagttatgcttttgcattttcttgaattttatgtttatttatctttcctctgtcattatttataattttatcacacatggctgtatcctttacatgttttggcattatgtatttttgaactttttgtaaagacaatcataccatgtgtaattttcagggacttgatttttttcattgacttttaagggttcaaatatattatcactgtggctgtagtttgccatattttgctgatatagagcattcattcacatgagggtaggattcagggtccatcaagacagagaaaacatacagtaatgtgaatagggaaagttaatatgaagaattattaattgttacagcattggaacaatgaaatattgtctagtaatatgtaaagagaagtctcaagaatatgtgatgagcagatgtaaggaattgctcttgtctccatggtgaatttggagcagccaatgaagagtcccctcacattgtggcctcgctcaaagttaagaagtcgctgtagtgttgcccttgaagaatctgcttcaaattgacacttcagaactccccagaaacttgtcttctgggccaatgtgtaaagctgtttatgaagaaatgtcaagccagaggggctctactacaaatttggcaaaggacaatttcaggagaagctcttggccgctgggttctcctggccaccatgaacttcaggaagtgggtgccatagcagcagcctgaactacagaatctgggcactggtgtagctctgtatgccctccgtgtcagatgctggagatgtcatttgcattgccagagtttgccaagggtgcacacagaaagcagattgaaaagcaccctcttggaacatctctccaatgccttctactcacaaagtttaacatcattaacacgtgacaaagaagaactatttaatgggcccagatctatttatgaagacaatcaagtgggagtttggagtggataacccaaatttggataactggtgaataataaaatgtatttatttctgctggtg

SEQ ID NO: 301 - RNA, 2675 nt, Homo sapiens
  source 1..2675: mol_type = unassigned RNA; note = Homo sapiens folate hydrolase 1 (FOLH1), transcript variant X2, mRNA, NCBI Reference Sequence: XM_017017433.2
gcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggtaggggggcgcctcgcggagcaaacctcggagtcttccccgtggtgccgcggtgctgggactcgcgggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 302 - RNA, 2433 nt, Homo sapiens
  source 1..2433: mol_type = unassigned RNA; note = Homo sapiens folate hydrolase 1 (FOLH1), transcript variant X3, mRNA, NCBI Reference Sequence: XM_017017434.1
cagatgttgcctctctctctcgctcggattggttcagtgcactctagaaacactgctgtggtggagaaactggaccccaggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 303 - RNA, 2344 nt, Homo sapiens
  source 1..2344: mol_type = unassigned RNA; note = Homo sapiens folate hydrolase 1 (FOLH1), transcript variant X4, mRNA, NCBI Reference Sequence: XM_017017435.2
gaggcagatgttgcctctctctctcgctcggattggttcagtgcactctagaaacactgctgtggtggagaaactggaccccaggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 304 - RNA, 2380 nt, Homo sapiens
  source 1..2380: mol_type = unassigned RNA; note = Homo sapiens folate hydrolase 1 (FOLH1), transcript variant X8, mRNA, NCBI Reference Sequence: XM_017017444.2
agtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 305 - RNA, 2509 nt, Homo sapiens
  source 1..2509: mol_type = unassigned RNA; note = Homo sapiens folate hydrolase 1 (FOLH1), transcript variant X9, mRNA, NCBI Reference Sequence: XM_017017445.1
atgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 306 - RNA, 2480 nt, Homo sapiens
  source 1..2480: mol_type = unassigned RNA; note = Homo sapiens folate hydrolase 1 (FOLH1), transcript variant X10, mRNA, NCBI Reference Sequence: XM_017017446.1
atgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggtaggggggcgcctcgcggagcaaacctcggagtcttccccgtggtgccgcggtgctgggactcgcggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 307 - RNA, 2150 nt, Homo sapiens
  source 1..2150: mol_type = unassigned RNA; note = Homo sapiens folate hydrolase 1 (FOLH1), transcript variant X11, mRNA, NCBI Reference Sequence: XM_017017447.1
gcagatgttgcctctctctctcgctcggattggttcagtgcactctagaaacactgctgtggtggagaaactggaccccagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 308 - RNA, 2142 nt, Homo sapiens
  source 1..2142: mol_type = unassigned RNA; note = Homo sapiens folate hydrolase 1 (FOLH1), transcript variant X12, mRNA, NCBI Reference Sequence: XM_017017448.1
gtcttttgctgtttttcctgggtactgatttgcagacttgatccaactttctaagaaaagcagaaccacacagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 309 - RNA, 2287 nt, Homo sapiens
  source 1..2287: mol_type = unassigned RNA; note = Homo sapiens folate hydrolase 1 (FOLH1), transcript variant X13, mRNA, NCBI Reference Sequence: XM_017017449.2
agtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 310 - RNA, 2417 nt, Homo sapiens
  source 1..2417: mol_type = unassigned RNA; note = Homo sapiens folate hydrolase 1 (FOLH1), transcript variant X14, mRNA, NCBI Reference Sequence: XM_017017450.2
gatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 311 - RNA, 2061 nt, Homo sapiens
  source 1..2061: mol_type = unassigned RNA; note = Homo sapiens folate hydrolase 1 (FOLH1), transcript variant X15, mRNA, NCBI Reference Sequence: XM_017017451.2
ggaggcagatgttgcctctctctctcgctcggattggttcagtgcactctagaaacactgctgtggtggagaaactggaccccagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 312 - RNA, 5515 nt, Homo sapiens
  source 1..5515: mol_type = unassigned RNA; note = Homo sapiens folate hydrolase 1 (FOLH1), transcript variant X16, mRNA, NCBI Reference Sequence: XM_024448411.1
taacagaggcaagcttgggaactgtgtgaaccaggtcagcaatctggacaggtctttaccagcgggtcttttgctgtttttcctgggtactgatttgcagacttgatccaactttctaagaaaagcagaaccacacagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggtaaggtaaaaattatctctttttttctctcccccaatgtaaaaagttatagtgggttttacatgtgtagaatcattttcttaaaactttatgaataccattattttcttgtattctgtgacatgcccaccttacagagaggacacatttactaggttatatcccggggttaaattcgagcattggaatttggccagtgtagatgtttagagtgaacagaacaaatttttctgtgcttacaggttatggctgtggcctacaaagaagcatgcactgggtttattattaactttcagtatctttgttttaaatattttctacaaaaatgtttactaaattaaattgtagtatgaattgttataaataatgagggaaaacaatttacacatagcaaatttaaaaattactgtcatttgatttgttaatatatttttctctttagtgggaaattaaattttaaaaaattccctttcgactgtagaacaaataggaatttggcctgtggggtctacttgcttattatatttgtaagctagtggtaggaaatagcaaatgctcactaccactaataagaacatttctaaatctgatgttctgaggatttttagagcttatagtagcaaaaagaaaagggaaattctatccgagatgtcctttgttgtaggcctaatgagaaaaggttgaagataaagttctggtactcatttaagtgtaatattgaaaattgatattaccgaatctggaacaaccaatttaaaataaggaaagaaagacactgtgttttctaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatggtgaatgatcaatccttgaatatcataggaaacttaacatttgaaagagactttattaaagaatttcctttggtacaatggactaagcatgtctttttttattctctttgcatttaagaatgaaagaattttgaactctaaagtgattggttcaggccccttacccccttattttgaaacttgggcctggtgggctttcaaattcagacttattcagctatttaaaaaacattatggtgttacacatataccataacttgcataacagtgacatagggggctgggacagaatatggggaaaaagtatataaatatttttgttgcagagtgtatgaatacttacgctaagtagtaagtggggggcggggaataaggaatataaacagacttatgtctactcaagtcaaattttgctttcaaatgagttcaggtcagatcaggttttgctgttaaataaattccccccagatttacagatttcacagtgtgggtaagggacaggagagcagaagttccataaactttttaaatggccaatttaggatatagggcccaggaaatgcatattgcttcatttctgtaagataacagagataactttcaaagagtgtttcctaaatgccagcattttacttgcattaacaaccctaaagctagggggtgttattatctcttattcacagggaggaaagtgagactagaagtcagcccaagatcacccctcctctgaatgggcagttggattcaaattcaggcagtctggctcacagagtccacatagtagtcttatgctgaaaggctcccctgtaaaacattaacaaagggagctaatttattttgaatgtgctcaactatttaatgatgtttacaaaaatctgtgatcattaagtttgtgtggtttaaagctaactaaatttttaaaacttgtataaaatactttgccaagttttctatgacatttatgtcttcatctggttttactcttaaattgtagactcctgtaaagagtatgtattttttttggctttgtaaatcttcttagaacataatacattgtcagagatttttttcttttttaaaaaatgacacatattaccctatagtaaaattatataaatctacctgaacttcatttgctccacctttttatttccaagttttaaaaaatgcagcttagcctaagctttattagttatgcaaagtcaaaataatgaaaataaaatgagattaactggaatgtttctgttgattttcttcaaatttgaatgatggtattttagggagaaattatgttatttctatggggctaatgtttattgaattatattttgtgctctatacatttttattttctttctaattttactttttattatggcataattctaacatatacaaaagtagagacagtcatcaacatgttgtcaatcttgttttatttgtttatctctccaattttattttgctattattctaaagaatttgaaaacaaatcccacacagcatatcattgtgtcattttacccataaaaacaaggatttgcagttacctaagtttcttattagattgttttaaaaacagagaaaaaaatggaaaaacaactctgatttttcttaagtctgaagaaatgataggatgtgtgtgcttattttgaggtacagtttacatgcaataaaatacatagatctcaagagttcagttcaataaattttgcaaattgcatgtgtttatgtcacttaaaatagaatataagggcctttccatcactctggaaagttcttttgtacccctttctggtcaattttctctgtgtcccctagaagcaatcactatctagtatctagcatcgtgtattcgtttgcctgggtttgaacttcaagtaagtggaatcaaacagtagatttttttttaaagccttgcttatttcagtgtagtaatttgagattttctatcatattgtatgtattagtttttttcttttgatgattgagtagcattccattgtgggattatactacggattgtttattcattcttctgttgttagaaacctagactttgtctaatatttggctaatataaatgtggctgttatgaacaattttgtacacgtcttcttgtgggcatgtgctcatctttctagagtacccaggagtggaattgctgtgccatagtgcacatttctgcttgacattgcttttcaaaagagttaccttaagtgattgtataattttagcctagattatcacaagcaatgtatgaggatttcagttgctctgcattctcgctaacatttgaattgttaatctgttttactttaacaattctagcaaatgtgaaattagaatgtatttaatgtgatttatagagaaccgtttgaatgaaactgagtttttactggaaatatggcaattttttttttcagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 313 - RNA, 2358 nt, Homo sapiens
  source 1..2358: mol_type = unassigned RNA; note = Homo sapiens folate hydrolase 1 (FOLH1), transcript variant X5, misc_RNA, NCBI Reference Sequence: XR_001747818.1
ggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggtaggggggcgcctcgcggagcaaacctcggagtcttccccgtggtgccgcggtgctgggactcgcgggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcct

SEQ ID NO: 314 - RNA, 2190 nt, Homo sapiens
  source 1..2190: mol_type = unassigned RNA; note = Homo sapiens folate hydrolase 1 (FOLH1), transcript variant X7, misc_RNA, NCBI Reference Sequence: XR_001747819.1
agatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcct

SEQ ID NO: 315 - RNA, 3946 nt, Homo sapiens
  source 1..3946: mol_type = unassigned RNA; note = Homo sapiens hypoxia inducible factor 1 subunit alpha (HIF1A), transcript variant 1, mRNA, NCBI Reference Sequence: NM_001530.4
agtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 316 - RNA, 3819 nt, Homo sapiens
  source 1..3819: mol_type = unassigned RNA; note = Homo sapiens hypoxia inducible factor 1 subunit alpha (HIF1A), transcript variant 2, mRNA, NCBI Reference Sequence: NM_181054.3
agtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 317 - RNA, 3865 nt, Homo sapiens
  source 1..3865: mol_type = unassigned RNA; note = Homo sapiens hypoxia inducible factor 1 subunit alpha (HIF1A), transcript variant 3, mRNA, NCBI Reference Sequence: NM_001243084.2
aataagtggtggttactcagcacttttagatgctgtttataatagatgaccttttctaactaatttacagttttttgaaagataactgagaggttgagggacggagattttcttcaagcaattttttttttcattttaaatgagctcccaatgtcggagtttggaaaacaaatttgtctttttaaaagaaggtctaggaaactcaaaacctgaagaattggaagaaatcagaatagaaaatggtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 318 - RNA, 2058 nt, Homo sapiens
  source 1..2058: mol_type = unassigned RNA; note = Homo sapiens serpin family H member 1 (SERPINH1), transcript variant 2, mRNA, NCBI Reference Sequence: NM_001235.5
aagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 319 - RNA, 2102 nt, Homo sapiens
  source 1..2102: mol_type = unassigned RNA; note = Homo sapiens serpin family H member 1 (SERPINH1), transcript variant 1, mRNA, NCBI Reference Sequence: NM_001207014.3
aagagtagaatcgtgtcgcggctcgagagcgagagtcacgtcccggcgctagcccagcccgacccagaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 320 - RNA, 2068 nt, Homo sapiens
  source 1..2068: mol_type = unassigned RNA; note = Homo sapiens serpin family H member 1 (SERPINH1), transcript variant X2, mRNA, NCBI Reference Sequence: XM_011545327.1
gtgcggcccgggggagcgccgagcaatctggggaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 321 - RNA, 2469 nt, Homo sapiens
  source 1..2469: mol_type = unassigned RNA; note = Homo sapiens serpin family H member 1 (SERPINH1), transcript variant X1, mRNA, NCBI Reference Sequence: XM_024448756.1
agtcctcggcactttgggggccgctggagggtttggaatcgagagcccagggctagccagtgatggtgccagctgagggctagggcggagatcggagccgggttgggagtccgtgcactcggaggactgggaaaaagtgcagggacccctaaaaggtggtggtggcagatacgagactaggtgctgtgtaaagggggctgggggcagagagcagagcctctgcggaaagaaacagaggaggaaggagatgggtctggtgcctcttcccgcaagggtagggaggataggccggcctcgcagttccaggtcacttccgttctggggttgaggctcaggggcagcggtgattggtggcccagcctcctcacaggcttgctgagggaatttgagcttccggtggtgggaaaggaggtgaaatcgtctcgactcctgggaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 322 - RNA, 4879 nt, Homo sapiens
  source 1..4879: mol_type = unassigned RNA; note = Homo sapiens protein tyrosine kinase 2 (PTK2), transcript variant 120, mRNA, NCBI Reference Sequence: NM_001387646.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattgcagaactggggctcccttgcatcttccagttacaaattcagtgccttctgcagtttccccagagctcctcaagaataacggaagggagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 323 - RNA, 4993 nt, Homo sapiens
  source 1..4993: mol_type = unassigned RNA; note = Homo sapiens protein tyrosine kinase 2 (PTK2), transcript variant 2, mRNA, NCBI Reference Sequence: NM_005607.5
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 324 - RNA, 5004 nt, Homo sapiens
  source 1..5004: mol_type = unassigned RNA; note = Homo sapiens protein tyrosine kinase 2 (PTK2), transcript variant 1, mRNA, NCBI Reference Sequence: NM_153831.4
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 325 - RNA, 5043 nt, Homo sapiens
  source 1..5043: mol_type = unassigned RNA; note = Homo sapiens protein tyrosine kinase 2 (PTK2), transcript variant 3, mRNA, NCBI Reference Sequence: NM_001199649.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccaggtaaagaagaaaagaattgggcggaaagaaatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 326 - RNA, 4796 nt, Homo sapiens
  source 1..4796: mol_type = unassigned RNA; note = Homo sapiens protein tyrosine kinase 2 (PTK2), transcript variant 4, mRNA, NCBI Reference Sequence: NM_001316342.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 327 - RNA, 4915 nt, Homo sapiens
  source 1..4915: mol_type = unassigned RNA; note = Homo sapiens protein tyrosine kinase 2 (PTK2), transcript variant 5, mRNA, NCBI Reference Sequence: NM_001352694.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 328 - RNA, 5043 nt, Homo sapiens
  source 1..5043: mol_type = unassigned RNA; note = Homo sapiens protein tyrosine kinase 2 (PTK2), transcript variant 6, mRNA, NCBI Reference Sequence: NM_001352695.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 329 - RNA, 4885 nt, Homo sapiens
  source 1..4885: mol_type = unassigned RNA; note = Homo sapiens protein tyrosine kinase 2 (PTK2), transcript variant 7, mRNA, NCBI Reference Sequence: NM_001352696.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 330 - RNA, 5461 nt, Homo sapiens
  source 1..5461: mol_type = unassigned RNA; note = Homo sapiens protein tyrosine kinase 2 (PTK2), transcript variant 8, mRNA, NCBI Reference Sequence: NM_001352697.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccaggcagaactggggctcccttgcatcttccagttacaaattcagtgccttctgcagtttccccagagctcctcaagaataacggaagggagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 331 - RNA, 5361 nt, Homo sapiens
  source 1..5361: mol_type = unassigned RNA; note = Homo sapiens protein tyrosine kinase 2 (PTK2), transcript variant 9, mRNA, NCBI Reference Sequence: NM_001352698.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccaggttcaagcaattgccctgcctcagcctcccgaatagctgggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 332 - RNA, 5044 nt, Homo sapiens
  source 1..5044: mol_type = unassigned RNA; note = Homo sapiens protein tyrosine kinase 2 (PTK2), transcript variant 10, mRNA, NCBI Reference Sequence: NM_001352699.2
cacaccgcggaagcccgggtcggtgtcggggcgagccttccctccttttcctggagcccgtctcaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 333 - RNA, 5047 nt, Homo sapiens
  source 1..5047: mol_type = unassigned RNA; note = Homo sapiens protein tyrosine kinase 2 (PTK2), transcript variant 11, mRNA, NCBI Reference Sequence: NM_001352700.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 334 - RNA, 5235 nt, Homo sapiens
  source 1..5235: mol_type = unassigned RNA; note = Homo sapiens protein tyrosine kinase 2 (PTK2), transcript variant 12, mRNA, NCBI Reference Sequence: NM_001352701.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 335 - RNA, 5136 nt, Homo sapiens
  source 1..5136: mol_type = unassigned RNA; note = Homo sapiens protein tyrosine kinase 2 (PTK2), transcript variant 13, mRNA, NCBI Reference Sequence: NM_001352702.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 336 - RNA, 5162 nt, Homo sapiens
  source 1..5162: mol_type = unassigned RNA; note = Homo sapiens protein tyrosine kinase 2 (PTK2), transcript variant 14, mRNA, NCBI Reference Sequence: NM_001352703.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagacagtgatgaaccagccttcttgtactggaggaatacaccatccgtcttcataaagactggcaggcacatggacaagtttaccagttataatgcttttcttacacattaaagaaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 337 - RNA, 5115 nt, Homo sapiens
  source 1..5115: mol_type = unassigned RNA; note = Homo sapiens protein tyrosine kinase 2 (PTK2), transcript variant 15, mRNA, NCBI Reference Sequence: NM_001352704.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 338 - RNA, 5277 nt, Homo sapiens
  source 1..5277: mol_type = unassigned RNA; note = Homo sapiens protein tyrosine kinase 2 (PTK2), transcript variant 16, mRNA, NCBI Reference Sequence: NM_001352705.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccaggttcaagcaattgccctgcctcagcctcccgaatagctgggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 339 - RNA, 4963 nt, Homo sapiens
  source 1..4963: mol_type = unassigned RNA; note = Homo sapiens protein tyrosine kinase 2 (PTK2), transcript variant 17, mRNA, NCBI Reference Sequence: NM_001352706.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 340 - RNA, 5078 nt, Homo sapiens
  source 1..5078: mol_type = unassigned RNA; note = Homo sapiens protein tyrosine kinase 2 (PTK2), transcript variant 18, mRNA, NCBI Reference Sequence: NM_001352707.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagacagtgatgaaccagccttcttgtactggaggaatacaccatccgtcttcataaagactggcaggcacatggacaagtttaccagttataatgcttttcttacacattaaagaaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 341 - RNA, 5021 nt, Homo sapiens
  source 1..5021: mol_type = unassigned RNA; note = Homo sapiens protein tyrosine kinase 2 (PTK2), transcript variant 19, mRNA, NCBI Reference Sequence: NM_001352708.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 342 - RNA, 5052 nt, Homo sapiens
  source 1..5052: mol_type = unassigned RNA; note = Homo sapiens protein tyrosine kinase 2 (PTK2), transcript variant 20, mRNA, NCBI Reference Sequence: NM_001352709.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 343 - RNA, 5019 nt, Homo sapiens
  source 1..5019: mol_type = unassigned RNA; note = Homo sapiens protein tyrosine kinase 2 (PTK2), transcript variant 21, mRNA, NCBI Reference Sequence: NM_001352710.2
agtcccggggcggatgcggcggagaccggcccctcccgcgcccccggcccgggttctgggaggaggggaggccggtggccgtgaggaggttgggggccctcgcggaggccgagaggcttaaggaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 344 - RNA, 4960 nt, Homo sapiens
  source 1..4960: mol_type = unassigned RNA; note = Homo sapiens protein tyrosine kinase 2 (PTK2), transcript variant 22, mRNA, NCBI Reference Sequence: NM_001352711.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 345 - RNA, 5242 nt, Homo sapiens
  source 1..5242: mol_type = unassigned RNA; note = Homo sapiens protein tyrosine kinase 2 (PTK2), transcript variant 23, mRNA, NCBI Reference Sequence: NM_001352712.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagacagtgatgaaccagccttcttgtactggaggaatacaccatccgtcttcataaagactggcaggcacatggacaagtttaccagttataatgcttttcttacacattaaagaagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 346 - RNA, 4945 nt, Homo sapiens
  source 1..4945: mol_type = unassigned RNA; note = Homo sapiens protein tyrosine kinase 2 (PTK2), transcript variant 24, mRNA, NCBI Reference Sequence: NM_001352713.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 347 - RNA, 5034 nt, Homo sapiens
  source 1..5034: mol_type = unassigned RNA; note = Homo sapiens protein tyrosine kinase 2 (PTK2), transcript variant 25, mRNA, NCBI Reference Sequence: NM_001352714.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 348 - RNA, 4942 nt, Homo sapiens
  source 1..4942: mol_type = unassigned RNA; note = Homo sapiens protein tyrosine kinase 2 (PTK2), transcript variant 26, mRNA, NCBI Reference Sequence: NM_001352715.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 349 - RNA, 5028 nt, Homo sapiens
  source 1..5028: mol_type = unassigned RNA; note = Homo sapiens protein tyrosine kinase 2 (PTK2), transcript variant 27, mRNA, NCBI Reference Sequence: NM_001352716.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 350 - RNA, 5022 nt, Homo sapiens
  source 1..5022: mol_type = unassigned RNA; note = Homo sapiens protein tyrosine kinase 2 (PTK2), transcript variant 28, mRNA, NCBI Reference Sequence: NM_001352717.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 351 - RNA, 5013 nt, Homo sapiens
  source 1..5013: mol_type = unassigned RNA; note = Homo sapiens protein tyrosine kinase 2 (PTK2), transcript variant 29, mRNA, NCBI Reference Sequence: NM_001352718.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 352 - RNA, 4982 nt, Homo sapiens
  source 1..4982: mol_type = unassigned RNA; note = Homo sapiens protein tyrosine kinase 2 (PTK2), transcript variant 30, mRNA, NCBI Reference Sequence: NM_001352719.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 353 - RNA, 4924 nt, Homo sapiens
  source 1..4924: mol_type = unassigned RNA; note = Homo sapiens protein tyrosine kinase 2 (PTK2), transcript variant 31, mRNA, NCBI Reference Sequence: NM_001352720.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 354 - RNA, 4900 nt, Homo sapiens
  source 1..4900: mol_type = unassigned RNA; note = Homo sapiens protein tyrosine kinase 2 (PTK2), transcript variant 32, mRNA, NCBI Reference Sequence: NM_001352721.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 355 - RNA, 4958 nt, Homo sapiens
  source 1..4958: mol_type = unassigned RNA; note = Homo sapiens protein tyrosine kinase 2 (PTK2), transcript variant 33, mRNA, NCBI Reference Sequence: NM_001352722.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 356 - RNA, 4989 nt, Homo sapiens
  source 1..4989: mol_type = unassigned RNA; note = Homo sapiens protein tyrosine kinase 2 (PTK2), transcript variant 34, mRNA, NCBI Reference Sequence: NM_001352723.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 357 - RNA, 4971 nt, Homo sapiens
  source 1..4971: mol_type = unassigned RNA; note = Homo sapiens protein tyrosine kinase 2 (PTK2), transcript variant 35, mRNA, NCBI Reference Sequence: NM_001352724.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 358 - RNA, 5008 nt, Homo sapiens
  source 1..5008: mol_type = unassigned RNA; note = Homo sapiens protein tyrosine kinase 2 (PTK2), transcript variant 36, mRNA, NCBI Reference Sequence: NM_001352725.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattgcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 359 - RNA, 4944 nt, Homo sapiens
  source 1..4944: mol_type = unassigned RNA; note = Homo sapiens protein tyrosine kinase 2 (PTK2), transcript variant 37, mRNA, NCBI Reference Sequence: NM_001352726.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 360 - RNA, 4819 nt, Homo sapiens
  source 1..4819: mol_type = unassigned RNA; note = Homo sapiens protein tyrosine kinase 2 (PTK2), transcript variant 38, mRNA, NCBI Reference Sequence: NM_001352727.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 361 - RNA, 4807 nt, Homo sapiens
  source 1..4807: mol_type = unassigned RNA; note = Homo sapiens protein tyrosine kinase 2 (PTK2), transcript variant 39, mRNA, NCBI Reference Sequence: NM_001352728.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 362 - RNA, 4792 nt, Homo sapiens
  source 1..4792: mol_type = unassigned RNA; note = Homo sapiens protein tyrosine kinase 2 (PTK2), transcript variant 40, mRNA, NCBI Reference Sequence: NM_001352729.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 363 - RNA, 4880 nt, Homo sapiens
  source 1..4880: mol_type = unassigned RNA; note = Homo sapiens protein tyrosine kinase 2 (PTK2), transcript variant 41, mRNA, NCBI Reference Sequence: NM_001352730.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 364 - RNA, 4963 nt, Homo sapiens
  source 1..4963: mol_type = unassigned RNA; note = Homo sapiens protein tyrosine kinase 2 (PTK2), transcript variant 42, mRNA, NCBI Reference Sequence: NM_001352731.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 365 - RNA, 4871 nt, Homo sapiens
  source 1..4871: mol_type = unassigned RNA; note = Homo sapiens protein tyrosine kinase 2 (PTK2), transcript variant 43, mRNA, NCBI Reference Sequence: NM_001352732.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 366 - RNA, 4859 nt, Homo sapiens
  source 1..4859: mol_type = unassigned RNA; note = Homo sapiens protein tyrosine kinase 2 (PTK2), transcript variant 44, mRNA, NCBI Reference Sequence: NM_001352733.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 367 - RNA, 4817 nt, Homo sapiens
  source 1..4817: mol_type = unassigned RNA; note = Homo sapiens protein tyrosine kinase 2 (PTK2), transcript variant 45, mRNA, NCBI Reference Sequence: NM_001352734.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 368 - RNA, 4875 nt, Homo sapiens
  source 1..4875: mol_type = unassigned RNA; note = Homo sapiens protein tyrosine kinase 2 (PTK2), transcript variant 46, mRNA, NCBI Reference Sequence: NM_001352735.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacgaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 369 - RNA, 4865 nt, Homo sapiens
  source 1..4865: mol_type = unassigned RNA; note = Homo sapiens protein tyrosine kinase 2 (PTK2), transcript variant 47, mRNA, NCBI Reference Sequence: NM_001352736.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 370 - RNA, 4928 nt, Homo sapiens
  source 1..4928: mol_type = unassigned RNA; note = Homo sapiens protein tyrosine kinase 2 (PTK2), transcript variant 48, mRNA, NCBI Reference Sequence: NM_001352737.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 371 - RNA, 4790 nt, Homo sapiens
  source 1..4790: mol_type = unassigned RNA; note = Homo sapiens protein tyrosine kinase 2 (PTK2), transcript variant 49, mRNA, NCBI Reference Sequence: NM_001352738.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 372 - RNA, 4893 nt, Homo sapiens
  source 1..4893: mol_type = unassigned RNA; note = Homo sapiens protein tyrosine kinase 2 (PTK2), transcript variant 50, mRNA, NCBI Reference Sequence: NM_001352739.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagacagtgatgaaccagccttcttgtactggaggaatacaccatccgtcttcataaagactggcaggcacatggacaagtttaccagttataatgcttttcttacacattaaagaaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 373 - RNA, 4864 nt, Homo sapiens
  source 1..4864: mol_type = unassigned RNA; note = Homo sapiens protein tyrosine kinase 2 (PTK2), transcript variant 51, mRNA, NCBI Reference Sequence: NM_001352740.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 374 - RNA, 4757 nt, Homo sapiens
  source 1..4757: mol_type = unassigned RNA; note = Homo sapiens protein tyrosine kinase 2 (PTK2), transcript variant 52, mRNA, NCBI Reference Sequence: NM_001352741.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 375 - RNA, 4733 nt, Homo sapiens
  source 1..4733: mol_type = unassigned RNA; note = Homo sapiens protein tyrosine kinase 2 (PTK2), transcript variant 53, mRNA, NCBI Reference Sequence: NM_001352742.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacgaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 376 - RNA, 4822 nt, Homo sapiens
  source 1..4822: mol_type = unassigned RNA; note = Homo sapiens protein tyrosine kinase 2 (PTK2), transcript variant 54, mRNA, NCBI Reference Sequence: NM_001352743.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 377 - RNA, 4688 nt, Homo sapiens
  source 1..4688: mol_type = unassigned RNA; note = Homo sapiens protein tyrosine kinase 2 (PTK2), transcript variant 55, mRNA, NCBI Reference Sequence: NM_001352744.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 378 - RNA, 4670 nt, Homo sapiens
  source 1..4670: mol_type = unassigned RNA; note = Homo sapiens protein tyrosine kinase 2 (PTK2), transcript variant 56, mRNA, NCBI Reference Sequence: NM_001352745.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 379 - RNA, 4625 nt, Homo sapiens
  source 1..4625: mol_type = unassigned RNA; note = Homo sapiens protein tyrosine kinase 2 (PTK2), transcript variant 57, mRNA, NCBI Reference Sequence: NM_001352746.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacgaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 380 - RNA, 5141 nt, Homo sapiens
  source 1..5141: mol_type = unassigned RNA; note = Homo sapiens protein tyrosine kinase 2 (PTK2), transcript variant 58, mRNA, NCBI Reference Sequence: NM_001352747.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagcctgtaagtgtctagaaatttctgtggaactccatttgactttctatctgtgaaatccaaactgtctctgaagaaataagaaaaatagtgttttgacttttaggagacaactatgtttattattttgccttgcaaattaatgtctaaatttgtacaagcacctatctacagatttttccagtaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 381 - RNA, 1856 nt, Homo sapiens
  source 1..1856: mol_type = unassigned RNA; note = Homo sapiens protein tyrosine kinase 2 (PTK2), transcript variant 59, mRNA, NCBI Reference Sequence: NM_001352748.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagcctgccttaagctccctggggataaggaccatgtttgtttcgctcaccactccatactcagtgtcctgcacagtacttgacacctagagaacacctggtagatgtttgtcattctggtgtccttcattatatgtgcatcaaatgaatgccttctgttttccattgtaataaataccacccaacagtccaataaattaataattcatagagtaa

SEQ ID NO: 382 - RNA, 2957 nt, Homo sapiens
  source 1..2957: mol_type = unassigned RNA; note = Homo sapiens protein tyrosine kinase 2 (PTK2), transcript variant 60, mRNA, NCBI Reference Sequence: NM_001352749.2
gtcattattagaactctagagttgtaggaatgtaggaagagctgtttgccacagttaggacgagggtttcaaactgtctgctgagccctggggcatctgcgtggaatgggaaactagcaaagtctcgctttggctgcattctgaggggtttatgtgatggcaaacagccaagatgaagaagctgcctagcagtcgctgcagcggctgcagcgttatgtgggacttcagatagcttctgagtagtcaagcagtgcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 383 - RNA, 2948 nt, Homo sapiens
  source 1..2948: mol_type = unassigned RNA; note = Homo sapiens protein tyrosine kinase 2 (PTK2), transcript variant 61, mRNA, NCBI Reference Sequence: NM_001352750.2
gtcattattagaactctagagttgtaggaatgtaggaagagctgtttgccacagttaggacgagggtttcaaactgtctgctgagccctggggcatctgcgtggaatgggaaactagcaaagtctcgctttggctgcattctgaggggtttatgtgatggcaaacagccaagatgaagaagctgcctagcagtcgctgcagcggctgcagcgttatgtgggacttcagatagcttctgagtagtcaagcagtgcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 384 - RNA, 2894 nt, Homo sapiens
  source 1..2894: mol_type = unassigned RNA; note = Homo sapiens protein tyrosine kinase 2 (PTK2), transcript variant 62, mRNA, NCBI Reference Sequence: NM_001352751.2
gtcattattagaactctagagttgtaggaatgtaggaagagctgtttgccacagttaggacgagggtttcaaactgtctgctgagccctggggcatctgcgtggaatgggaaactagcaaagtctcgctttggctgcattctgaggggtttatgtgatggcaaacagccaagatgaagaagctgcctagcagtcgctgcagcggctgcagcgttatgtgggacttcagatagcttctgagtagtcaagcagtgcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 385 - RNA, 2885 nt, Homo sapiens
  source 1..2885: mol_type = unassigned RNA; note = Homo sapiens protein tyrosine kinase 2 (PTK2), transcript variant 63, mRNA, NCBI Reference Sequence: NM_001352752.2
gtcattattagaactctagagttgtaggaatgtaggaagagctgtttgccacagttaggacgagggtttcaaactgtctgctgagccctggggcatctgcgtggaatgggaaactagcaaagtctcgctttggctgcattctgaggggtttatgtgatggcaaacagccaagatgaagaagctgcctagcagtcgctgcagcggctgcagcgttatgtgggacttcagatagcttctgagtagtcaagcagtgcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 386 - RNA, 4154 nt, Homo sapiens
  source 1..4154: mol_type = unassigned RNA; note = Homo sapiens protein tyrosine kinase 2 (PTK2), transcript variant 68, mRNA, NCBI Reference Sequence: NM_001387584.1
cacaccgcggaagcccgggtcggtgtcggggcgagccttccctccttttcctggagcccgtctcagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 387 - RNA, 4258 nt, Homo sapiens
  source 1..4258: mol_type = unassigned RNA; note = Homo sapiens protein tyrosine kinase 2 (PTK2), transcript variant 69, mRNA, NCBI Reference Sequence: NM_001387585.1
cacaccgcggaagcccgggtcggtgtcggggcgagccttccctccttttcctggagcccgtctcagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 388 - RNA, 4321 nt, Homo sapiens
  source 1..4321: mol_type = unassigned RNA; note = Homo sapiens protein tyrosine kinase 2 (PTK2), transcript variant 70, mRNA, NCBI Reference Sequence: NM_001387586.1
cacaccgcggaagcccgggtcggtgtcggggcgagccttccctccttttcctggagcccgtctcagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 389 - RNA, 4410 nt, Homo sapiens
  source 1..4410: mol_type = unassigned RNA; note = Homo sapiens protein tyrosine kinase 2 (PTK2), transcript variant 71, mRNA, NCBI Reference Sequence: NM_001387587.1
cacaccgcggaagcccgggtcggtgtcggggcgagccttccctccttttcctggagcccgtctcaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 390 - RNA, 2299 nt, Homo sapiens
  source 1..2299: mol_type = unassigned RNA; note = Homo sapiens protein tyrosine kinase 2 (PTK2), transcript variant 72, mRNA, NCBI Reference Sequence: NM_001387588.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattgcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaagtaagatacaaacctgctttggtgtgatgcacacttgatttcttttgctttttaaaaacatgcacaagataacaaatgtatatgtttaattttcacactgcttgtcattacaactctggtataaataaaattcgttagtaattattaacgaatgatctcttctagacctctagtctagcttttgggtattattaattatactttgagccatctgatttccgttttctgtgatggtcttttgctagctaatttctcatcagtgctactttgtttcaacctttgctcccaataaaactcaaatcatatatatatgtgtgtgtgtatgtatatatatataatgttttcatcccttgtcatccttttatgtagcaggagttgctgtcactcctaaataccttattaatgggctacatagcttgttttattatgccctgtaatctagagcgcacctacaaagagtgagtgtatatttgatattcacatgcaacgttaaaattaggacgtaatctcttaatgactcctgttgaaatgttaaggaaaataaaattatttcagggcaaattaaaagaattccctataattgttctttttctggtctcccctactaattttttttttttttttttactactaagcaactcaagatgttactaggaaattgtacatctaaaatacatttgtgagaggtataacttgtaaaaatgggcttctttcactagggttctaatttttataggcaatgctacagaaataaagataattgtaggctgaagagtgcattcaaagggtcagtaactttgaaggatctagattgattagggtagacattttaaaagacaaacatgttaaggtgaataattttttttttttcttttttgagacagagtctcgccctgtcacccaggctgcagtacggtggcatgaacatggctcactgcagcctcttgggctcaagcgattctcccacttcagcttcttgagtagctgggactgtaggcacagaccgccacgcccagctaatttttgtattgtttacagagctggggtttcagcatgttgcccagacagatctcaaactcctgggctcaaacagtctgcccaccttggcctcccaaagtgttgggattacaggtgtgagccaccatgcccagcctgaataaatcttatgttgaataaaaccctacgccagttacagagttcatcaaagaaatatagctgtattttcaaatttgtcaggtagctggtaccaagctaacaaaatactccttgagaatatagtttcattggttcacatcaatggctagagaagatttgacttccaactatttagtcaattaagcaagtgagcattccaaaacaaaggatatgtaaaagttagataaaaatacctgcagggtttttgtgttgttttgttttttgagatggtcatcttgctgtgttgcttgggctggtcttgaactcccctactcaggtgatcctcctgtgtcaaggtacttttatttaacacaagtctattatcttggtttatatggacatgtcagatgcagactttgttataatgaaatccttagtgctcaataaaatggtcattgaatctaaa

SEQ ID NO: 391 - RNA, 2466 nt, Homo sapiens
  source 1..2466: mol_type = unassigned RNA; note = Homo sapiens protein tyrosine kinase 2 (PTK2), transcript variant 73, mRNA, NCBI Reference Sequence: NM_001387589.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccaggttcaagcaattgccctgcctcagcctcccgaatagctgggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaagtaagatacaaacctgctttggtgtgatgcacacttgatttcttttgctttttaaaaacatgcacaagataacaaatgtatatgtttaattttcacactgcttgtcattacaactctggtataaataaaattcgttagtaattattaacgaatgatctcttctagacctctagtctagcttttgggtattattaattatactttgagccatctgatttccgttttctgtgatggtcttttgctagctaatttctcatcagtgctactttgtttcaacctttgctcccaataaaactcaaatcatatatatatgtgtgtgtgtatgtatatatatataatgttttcatcccttgtcatccttttatgtagcaggagttgctgtcactcctaaataccttattaatgggctacatagcttgttttattatgccctgtaatctagagcgcacctacaaagagtgagtgtatatttgatattcacatgcaacgttaaaattaggacgtaatctcttaatgactcctgttgaaatgttaaggaaaataaaattatttcagggcaaattaaaagaattccctataattgttctttttctggtctcccctactaattttttttttttttttttactactaagcaactcaagatgttactaggaaattgtacatctaaaatacatttgtgagaggtataacttgtaaaaatgggcttctttcactagggttctaatttttataggcaatgctacagaaataaagataattgtaggctgaagagtgcattcaaagggtcagtaactttgaaggatctagattgattagggtagacattttaaaagacaaacatgttaaggtgaataattttttttttttcttttttgagacagagtctcgccctgtcacccaggctgcagtacggtggcatgaacatggctcactgcagcctcttgggctcaagcgattctcccacttcagcttcttgagtagctgggactgtaggcacagaccgccacgcccagctaatttttgtattgtttacagagctggggtttcagcatgttgcccagacagatctcaaactcctgggctcaaacagtctgcccaccttggcctcccaaagtgttgggattacaggtgtgagccaccatgcccagcctgaataaatcttatgttgaataaaaccctacgccagttacagagttcatcaaagaaatatagctgtattttcaaatttgtcaggtagctggtaccaagctaacaaaatactccttgagaatatagtttcattggttcacatcaatggctagagaagatttgacttccaactatttagtcaattaagcaagtgagcattccaaaacaaaggatatgtaaaagttagataaaaatacctgcagggtttttgtgttgttttgttttttgagatggtcatcttgctgtgttgcttgggctggtcttgaactcccctactcaggtgatcctcctgtgtcaaggtacttttatttaacacaagtctattatcttggtttatatggacatgtcagatgcagactttgttataatgaaatccttagtgctcaataaaatggtcattgaatctaaa

SEQ ID NO: 392 - RNA, 4138 nt, Homo sapiens
  source 1..4138: mol_type = unassigned RNA; note = Homo sapiens protein tyrosine kinase 2 (PTK2), transcript variant 74, mRNA, NCBI Reference Sequence: NM_001387590.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 393 - RNA, 4183 nt, Homo sapiens
  source 1..4183: mol_type = unassigned RNA; note = Homo sapiens protein tyrosine kinase 2 (PTK2), transcript variant 75, mRNA, NCBI Reference Sequence: NM_001387591.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 394 - RNA, 4191 nt, Homo sapiens
  source 1..4191: mol_type = unassigned RNA; note = Homo sapiens protein tyrosine kinase 2 (PTK2), transcript variant 76, mRNA, NCBI Reference Sequence: NM_001387592.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagagccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 395 - RNA, 4192 nt, Homo sapiens
  source 1..4192: mol_type = unassigned RNA; note = Homo sapiens protein tyrosine kinase 2 (PTK2), transcript variant 77, mRNA, NCBI Reference Sequence: NM_001387603.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 396 - RNA, 4200 nt, Homo sapiens
  source 1..4200: mol_type = unassigned RNA; note = Homo sapiens protein tyrosine kinase 2 (PTK2), transcript variant 78, mRNA, NCBI Reference Sequence: NM_001387604.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagagccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 397 - RNA, 4246 nt, Homo sapiens
  source 1..4246: mol_type = unassigned RNA; note = Homo sapiens protein tyrosine kinase 2 (PTK2), transcript variant 79, mRNA, NCBI Reference Sequence: NM_001387605.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 398 - RNA, 4276 nt, Homo sapiens
  source 1..4276: mol_type = unassigned RNA; note = Homo sapiens protein tyrosine kinase 2 (PTK2), transcript variant 80, mRNA, NCBI Reference Sequence: NM_001387606.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 399 - RNA, 4285 nt, Homo sapiens
  source 1..4285: mol_type = unassigned RNA; note = Homo sapiens protein tyrosine kinase 2 (PTK2), transcript variant 81, mRNA, NCBI Reference Sequence: NM_001387607.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 400 - RNA, 4304 nt, Homo sapiens
  source 1..4304: mol_type = unassigned RNA; note = Homo sapiens protein tyrosine kinase 2 (PTK2), transcript variant 82, mRNA, NCBI Reference Sequence: NM_001387608.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 401 - RNA, 4313 nt, Homo sapiens
  source 1..4313: mol_type = unassigned RNA; note = Homo sapiens protein tyrosine kinase 2 (PTK2), transcript variant 83, mRNA, NCBI Reference Sequence: NM_001387609.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 402 - RNA, 4320 nt, Homo sapiens
  source 1..4320: mol_type = unassigned RNA; note = Homo sapiens protein tyrosine kinase 2 (PTK2), transcript variant 84, mRNA, NCBI Reference Sequence: NM_001387610.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagagtcatgaaggaaacagtggaagtcagagaaactcacatatccaggagttgcctaaagaaacaggatgattacagaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 403 - RNA, 4322 nt, Homo sapiens
  source 1..4322: mol_type = unassigned RNA; note = Homo sapiens protein tyrosine kinase 2 (PTK2), transcript variant 85, mRNA, NCBI Reference Sequence: NM_001387611.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 404 - RNA, 4335 nt, Homo sapiens
  source 1..4335: mol_type = unassigned RNA; note = Homo sapiens protein tyrosine kinase 2 (PTK2), transcript variant 86, mRNA, NCBI Reference Sequence: NM_001387612.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 405 - RNA, 4344 nt, Homo sapiens
  source 1..4344: mol_type = unassigned RNA; note = Homo sapiens protein tyrosine kinase 2 (PTK2), transcript variant 87, mRNA, NCBI Reference Sequence: NM_001387613.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 406 - RNA, 4350 nt, Homo sapiens
  source 1..4350: mol_type = unassigned RNA; note = Homo sapiens protein tyrosine kinase 2 (PTK2), transcript variant 88, mRNA, NCBI Reference Sequence: NM_001387614.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 407 - RNA, 4353 nt, Homo sapiens
  source 1..4353: mol_type = unassigned RNA; note = Homo sapiens protein tyrosine kinase 2 (PTK2), transcript variant 89, mRNA, NCBI Reference Sequence: NM_001387615.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 408 - RNA, 4358 nt, Homo sapiens
  source 1..4358: mol_type = unassigned RNA; note = Homo sapiens protein tyrosine kinase 2 (PTK2), transcript variant 90, mRNA, NCBI Reference Sequence: NM_001387616.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagagccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 409 - RNA, 4379 nt, Homo sapiens
  source 1..4379: mol_type = unassigned RNA; note = Homo sapiens protein tyrosine kinase 2 (PTK2), transcript variant 91, mRNA, NCBI Reference Sequence: NM_001387617.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagagccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 410 - RNA, 4393 nt, Homo sapiens
  source 1..4393: mol_type = unassigned RNA; note = Homo sapiens protein tyrosine kinase 2 (PTK2), transcript variant 92, mRNA, NCBI Reference Sequence: NM_001387618.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattgcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 411 - RNA, 4394 nt, Homo sapiens
  source 1..4394: mol_type = unassigned RNA; note = Homo sapiens protein tyrosine kinase 2 (PTK2), transcript variant 93, mRNA, NCBI Reference Sequence: NM_001387619.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 412 - RNA, 4409 nt, Homo sapiens
  source 1..4409: mol_type = unassigned RNA; note = Homo sapiens protein tyrosine kinase 2 (PTK2), transcript variant 94, mRNA, NCBI Reference Sequence: NM_001387620.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagacagtgatgaaccagccttcttgtactggaggaatacaccatccgtcttcataaagactggcaggcacatggacaagtttaccagttataatgcttttcttacacattaaagaaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 413 - RNA, 4416 nt, Homo sapiens
  source 1..4416: mol_type = unassigned RNA; note = Homo sapiens protein tyrosine kinase 2 (PTK2), transcript variant 95, mRNA, NCBI Reference Sequence: NM_001387621.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagagccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 414 - RNA, 4431 nt, Homo sapiens
  source 1..4431: mol_type = unassigned RNA; note = Homo sapiens protein tyrosine kinase 2 (PTK2), transcript variant 96, mRNA, NCBI Reference Sequence: NM_001387622.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 415 - RNA, 4434 nt, Homo sapiens
  source 1..4434: mol_type = unassigned RNA; note = Homo sapiens protein tyrosine kinase 2 (PTK2), transcript variant 97, mRNA, NCBI Reference Sequence: NM_001387623.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 416 - RNA, 4437 nt, Homo sapiens
  source 1..4437: mol_type = unassigned RNA; note = Homo sapiens protein tyrosine kinase 2 (PTK2), transcript variant 98, mRNA, NCBI Reference Sequence: NM_001387624.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 417 - RNA, 4448 nt, Homo sapiens
  source 1..4448: mol_type = unassigned RNA; note = Homo sapiens protein tyrosine kinase 2 (PTK2), transcript variant 99, mRNA, NCBI Reference Sequence: NM_001387625.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 418 - RNA, 4457 nt, Homo sapiens
  source 1..4457: mol_type = unassigned RNA; note = Homo sapiens protein tyrosine kinase 2 (PTK2), transcript variant 101, mRNA, NCBI Reference Sequence: NM_001387627.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 419 - RNA, 4471 nt, Homo sapiens
  source 1..4471: mol_type = unassigned RNA; note = Homo sapiens protein tyrosine kinase 2 (PTK2), transcript variant 102, mRNA, NCBI Reference Sequence: NM_001387628.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 420 - RNA, 4474 nt, Homo sapiens
  source 1..4474: mol_type = unassigned RNA; note = Homo sapiens protein tyrosine kinase 2 (PTK2), transcript variant 103, mRNA, NCBI Reference Sequence: NM_001387629.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagagccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 421 - RNA, 4487 nt, Homo sapiens
  source 1..4487: mol_type = unassigned RNA; note = Homo sapiens protein tyrosine kinase 2 (PTK2), transcript variant 104, mRNA, NCBI Reference Sequence: NM_001387630.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagagtcatgaaggaaacagtggaagtcagagaaactcacatatccaggagttgcctaaagaaacaggatgattacagaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 422 - RNA, 4495 nt, Homo sapiens
  source 1..4495: mol_type = unassigned RNA; note = Homo sapiens protein tyrosine kinase 2 (PTK2), transcript variant 105, mRNA, NCBI Reference Sequence: NM_001387631.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 423 - RNA, 4497 nt, Homo sapiens
  source 1..4497: mol_type = unassigned RNA; note = Homo sapiens protein tyrosine kinase 2 (PTK2), transcript variant 106, mRNA, NCBI Reference Sequence: NM_001387632.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattgcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 424 - RNA, 4527 nt, Homo sapiens
  source 1..4527: mol_type = unassigned RNA; note = Homo sapiens protein tyrosine kinase 2 (PTK2), transcript variant 107, mRNA, NCBI Reference Sequence: NM_001387633.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattgcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 425 - RNA, 4529 nt, Homo sapiens
  source 1..4529: mol_type = unassigned RNA; note = Homo sapiens protein tyrosine kinase 2 (PTK2), transcript variant 108, mRNA, NCBI Reference Sequence: NM_001387634.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 426 - RNA, 4541 nt, Homo sapiens
  source 1..4541: mol_type = unassigned RNA; note = Homo sapiens protein tyrosine kinase 2 (PTK2), transcript variant 109, mRNA, NCBI Reference Sequence: NM_001387635.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccaggttcaagcaattgccctgcctcagcctcccgaatagctgggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 427 - RNA, 4560 nt, Homo sapiens
  source 1..4560: mol_type = unassigned RNA; note = Homo sapiens protein tyrosine kinase 2 (PTK2), transcript variant 110, mRNA, NCBI Reference Sequence: NM_001387636.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattgcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 428 - RNA, 4601 nt, Homo sapiens
  source 1..4601: mol_type = unassigned RNA; note = Homo sapiens protein tyrosine kinase 2 (PTK2), transcript variant 111, mRNA, NCBI Reference Sequence: NM_001387637.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 429 - RNA, 4610 nt, Homo sapiens
  source 1..4610: mol_type = unassigned RNA; note = Homo sapiens protein tyrosine kinase 2 (PTK2), transcript variant 112, mRNA, NCBI Reference Sequence: NM_001387638.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 430 - RNA, 4649 nt, Homo sapiens
  source 1..4649: mol_type = unassigned RNA; note = Homo sapiens protein tyrosine kinase 2 (PTK2), transcript variant 113, mRNA, NCBI Reference Sequence: NM_001387639.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 431 - RNA, 4670 nt, Homo sapiens
  source 1..4670: mol_type = unassigned RNA; note = Homo sapiens protein tyrosine kinase 2 (PTK2), transcript variant 114, mRNA, NCBI Reference Sequence: NM_001387640.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 432 - RNA, 4727 nt, Homo sapiens
  source 1..4727: mol_type = unassigned RNA; note = Homo sapiens protein tyrosine kinase 2 (PTK2), transcript variant 115, mRNA, NCBI Reference Sequence: NM_001387641.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccaggttcaagcaattgccctgcctcagcctcccgaatagctgggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 433 - RNA, 4816 nt, Homo sapiens
  source 1..4816: mol_type = unassigned RNA; note = Homo sapiens protein tyrosine kinase 2 (PTK2), transcript variant 116, mRNA, NCBI Reference Sequence: NM_001387642.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccaggttcaagcaattgccctgcctcagcctcccgaatagctgggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 434 - RNA, 4821 nt, Homo sapiens
  source 1..4821: mol_type = unassigned RNA; note = Homo sapiens protein tyrosine kinase 2 (PTK2), transcript variant 117, mRNA, NCBI Reference Sequence: NM_001387643.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 435 - RNA, 4838 nt, Homo sapiens
  source 1..4838: mol_type = unassigned RNA; note = Homo sapiens protein tyrosine kinase 2 (PTK2), transcript variant 118, mRNA, NCBI Reference Sequence: NM_001387644.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccaggttcaagcaattgccctgcctcagcctcccgaatagctgggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 436 - RNA, 4874 nt, Homo sapiens
  source 1..4874: mol_type = unassigned RNA; note = Homo sapiens protein tyrosine kinase 2 (PTK2), transcript variant 119, mRNA, NCBI Reference Sequence: NM_001387645.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccaggttcaagcaattgccctgcctcagcctcccgaatagctgggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaagatccatggttggttgaatctggatgtggaacccgctgacgtggatggctgactgtattgcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 437 - RNA, 4915 nt, Homo sapiens
  source 1..4915: mol_type = unassigned RNA; note = Homo sapiens protein tyrosine kinase 2 (PTK2), transcript variant 121, mRNA, NCBI Reference Sequence: NM_001387647.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccaggttcaagcaattgccctgcctcagcctcccgaatagctgggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaaggcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 438 - RNA, 4920 nt, Homo sapiens
  source 1..4920: mol_type = unassigned RNA; note = Homo sapiens protein tyrosine kinase 2 (PTK2), transcript variant 122, mRNA, NCBI Reference Sequence: NM_001387648.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 439 - RNA, 4968 nt, Homo sapiens
  source 1..4968: mol_type = unassigned RNA; note = Homo sapiens protein tyrosine kinase 2 (PTK2), transcript variant 123, mRNA, NCBI Reference Sequence: NM_001387649.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 440 - RNA, 5135 nt, Homo sapiens
  source 1..5135: mol_type = unassigned RNA; note = Homo sapiens protein tyrosine kinase 2 (PTK2), transcript variant 124, mRNA, NCBI Reference Sequence: NM_001387650.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccaggttcaagcaattgccctgcctcagcctcccgaatagctgggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaaggcagaactggggctcccttgcatcttccagttacaaattcagtgccttctgcagtttccccagagctcctcaagaataacggaagggagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 441 - RNA, 2119 nt, Homo sapiens
  source 1..2119: mol_type = unassigned RNA; note = Homo sapiens protein tyrosine kinase 2 (PTK2), transcript variant 125, mRNA, NCBI Reference Sequence: NM_001387651.1
agtcccggggcggatgcggcggagaccggcccctcccgcgcccccggcccgggttctgggaggaggggaggccggtggccgtgaggaggttgggggccctcgcggaggccgagaggcttaaggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaagtaagatacaaacctgctttggtgtgatgcacacttgatttcttttgctttttaaaaacatgcacaagataacaaatgtatatgtttaattttcacactgcttgtcattacaactctggtataaataaaattcgttagtaattattaacgaatgatctcttctagacctctagtctagcttttgggtattattaattatactttgagccatctgatttccgttttctgtgatggtcttttgctagctaatttctcatcagtgctactttgtttcaacctttgctcccaataaaactcaaatcatatatatatgtgtgtgtgtatgtatatatatataatgttttcatcccttgtcatccttttatgtagcaggagttgctgtcactcctaaataccttattaatgggctacatagcttgttttattatgccctgtaatctagagcgcacctacaaagagtgagtgtatatttgatattcacatgcaacgttaaaattaggacgtaatctcttaatgactcctgttgaaatgttaaggaaaataaaattatttcagggcaaattaaaagaattccctataattgttctttttctggtctcccctactaattttttttttttttttttactactaagcaactcaagatgttactaggaaattgtacatctaaaatacatttgtgagaggtataacttgtaaaaatgggcttctttcactagggttctaatttttataggcaatgctacagaaataaagataattgtaggctgaagagtgcattcaaagggtcagtaactttgaaggatctagattgattagggtagacattttaaaagacaaacatgttaaggtgaataattttttttttttcttttttgagacagagtctcgccctgtcacccaggctgcagtacggtggcatgaacatggctcactgcagcctcttgggctcaagcgattctcccacttcagcttcttgagtagctgggactgtaggcacagaccgccacgcccagctaatttttgtattgtttacagagctggggtttcagcatgttgcccagacagatctcaaactcctgggctcaaacagtctgcccaccttggcctcccaaagtgttgggattacaggtgtgagccaccatgcccagcctgaataaatcttatgttgaataaaaccctacgccagttacagagttcatcaaagaaatatagctgtattttcaaatttgtcaggtagctggtaccaagctaacaaaatactccttgagaatatagtttcattggttcacatcaatggctagagaagatttgacttccaactatttagtcaattaagcaagtgagcattccaaaacaaaggatatgtaaaagttagataaaaatacctgcagggtttttgtgttgttttgttttttgagatggtcatcttgctgtgttgcttgggctggtcttgaactcccctactcaggtgatcctcctgtgtcaaggtacttttatttaacacaagtctattatcttggtttatatggacatgtcagatgcagactttgttataatgaaatccttagtgctcaataaaatggtcattgaatctaaa

SEQ ID NO: 442 - RNA, 4213 nt, Homo sapiens
  source 1..4213: mol_type = unassigned RNA; note = Homo sapiens protein tyrosine kinase 2 (PTK2), transcript variant 126, mRNA, NCBI Reference Sequence: NM_001387652.1
agtcccggggcggatgcggcggagaccggcccctcccgcgcccccggcccgggttctgggaggaggggaggccggtggccgtgaggaggttgggggccctcgcggaggccgagaggcttaaggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 443 - RNA, 4272 nt, Homo sapiens
  source 1..4272: mol_type = unassigned RNA; note = Homo sapiens protein tyrosine kinase 2 (PTK2), transcript variant 127, mRNA, NCBI Reference Sequence: NM_001387653.1
agtcccggggcggatgcggcggagaccggcccctcccgcgcccccggcccgggttctgggaggaggggaggccggtggccgtgaggaggttgggggccctcgcggaggccgagaggcttaaggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 444 - RNA, 4302 nt, Homo sapiens
  source 1..4302: mol_type = unassigned RNA; note = Homo sapiens protein tyrosine kinase 2 (PTK2), transcript variant 128, mRNA, NCBI Reference Sequence: NM_001387654.1
agtcccggggcggatgcggcggagaccggcccctcccgcgcccccggcccgggttctgggaggaggggaggccggtggccgtgaggaggttgggggccctcgcggaggccgagaggcttaaggaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 445 - RNA, 4380 nt, Homo sapiens
  source 1..4380: mol_type = unassigned RNA; note = Homo sapiens protein tyrosine kinase 2 (PTK2), transcript variant 129, mRNA, NCBI Reference Sequence: NM_001387655.1
agtcccggggcggatgcggcggagaccggcccctcccgcgcccccggcccgggttctgggaggaggggaggccggtggccgtgaggaggttgggggccctcgcggaggccgagaggcttaaggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 446 - RNA, 4415 nt, Homo sapiens
  source 1..4415: mol_type = unassigned RNA; note = Homo sapiens protein tyrosine kinase 2 (PTK2), transcript variant 130, mRNA, NCBI Reference Sequence: NM_001387656.1
agtcccggggcggatgcggcggagaccggcccctcccgcgcccccggcccgggttctgggaggaggggaggccggtggccgtgaggaggttgggggccctcgcggaggccgagaggcttaaggaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 447 - RNA, 4469 nt, Homo sapiens
  source 1..4469: mol_type = unassigned RNA; note = Homo sapiens protein tyrosine kinase 2 (PTK2), transcript variant 131, mRNA, NCBI Reference Sequence: NM_001387657.1
agtcccggggcggatgcggcggagaccggcccctcccgcgcccccggcccgggttctgggaggaggggaggccggtggccgtgaggaggttgggggccctcgcggaggccgagaggcttaaggaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 448 - RNA, 4568 nt, Homo sapiens
  source 1..4568: mol_type = unassigned RNA; note = Homo sapiens protein tyrosine kinase 2 (PTK2), transcript variant 132, mRNA, NCBI Reference Sequence: NM_001387658.1
agtcccggggcggatgcggcggagaccggcccctcccgcgcccccggcccgggttctgggaggaggggaggccggtggccgtgaggaggttgggggccctcgcggaggccgagaggcttaaggaggcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 449 - RNA, 4641 nt, Homo sapiens
  source 1..4641: mol_type = unassigned RNA; note = Homo sapiens protein tyrosine kinase 2 (PTK2), transcript variant 133, mRNA, NCBI Reference Sequence: NM_001387659.1
agtcccggggcggatgcggcggagaccggcccctcccgcgcccccggcccgggttctgggaggaggggaggccggtggccgtgaggaggttgggggccctcgcggaggccgagaggcttaaggagagtctcgctctgccgcgcaggctggagtgcagtggtgtgatctcggcttactgcaacctttgccttctgggttcaagcaattgtgcctcagcctcctgagtagctggagttacaggtgtatgccaccacaccctgctaatttttgtatttttggtagaagtggggtttcaccatgttactcaggctggtcttgaacttctggcctcaagtgatctgcccacctcagcctctcaaagtgctgggattacagataatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 450 - RNA, 4788 nt, Homo sapiens
  source 1..4788: mol_type = unassigned RNA; note = Homo sapiens protein tyrosine kinase 2 (PTK2), transcript variant 134, mRNA, NCBI Reference Sequence: NM_001387660.1
agtcccggggcggatgcggcggagaccggcccctcccgcgcccccggcccgggttctgggaggaggggaggccggtggccgtgaggaggttgggggccctcgcggaggccgagaggcttaaggaggcagaactggggctcccttgcatcttccagttacaaattcagtgccttctgcagtttccccagagctcctcaagaataacggaagggagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 451 - RNA, 4846 nt, Homo sapiens
  source 1..4846: mol_type = unassigned RNA; note = Homo sapiens protein tyrosine kinase 2 (PTK2), transcript variant 135, mRNA, NCBI Reference Sequence: NM_001387661.1
agtcccggggcggatgcggcggagaccggcccctcccgcgcccccggcccgggttctgggaggaggggaggccggtggccgtgaggaggttgggggccctcgcggaggccgagaggcttaaggagatccatggttggttgaatctggatgtggaacccgctgacgtggatggctgactgtattgcagaactggggctcccttgcatcttccagttacaaattcagtgccttctgcagtttccccagagctcctcaagaataacggaagggagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 452 - RNA, 4855 nt, Homo sapiens
  source 1..4855: mol_type = unassigned RNA; note = Homo sapiens protein tyrosine kinase 2 (PTK2), transcript variant 136, mRNA, NCBI Reference Sequence: NM_001387662.1
agtcccggggcggatgcggcggagaccggcccctcccgcgcccccggcccgggttctgggaggaggggaggccggtggccgtgaggaggttgggggccctcgcggaggccgagaggcttaaggagatccatggttggttgaatctggatgtggaacccgctgacgtggatggctgactgtattgcagaactggggctcccttgcatcttccagttacaaattcagtgccttctgcagtttccccagagctcctcaagaataacggaagggagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 453 - RNA, 5024 nt, Homo sapiens
  source 1..5024: mol_type = unassigned RNA; note = Homo sapiens protein tyrosine kinase 2 (PTK2), transcript variant 64, non-coding RNA, NCBI Reference Sequence: NR_148036.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 454 - RNA, 5055 nt, Homo sapiens
  source 1..5055: mol_type = unassigned RNA; note = Homo sapiens protein tyrosine kinase 2 (PTK2), transcript variant 65, non-coding RNA, NCBI Reference Sequence: NR_148037.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagacagtgatgaaccagccttcttgtactggaggaatacaccatccgtcttcataaagactggcaggcacatggacaagtttaccagttataatgcttttcttacacattaaagaagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 455 - RNA, 4773 nt, Homo sapiens
  source 1..4773: mol_type = unassigned RNA; note = Homo sapiens protein tyrosine kinase 2 (PTK2), transcript variant 66, non-coding RNA, NCBI Reference Sequence: NR_148038.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 456 - RNA, 4665 nt, Homo sapiens
  source 1..4665: mol_type = unassigned RNA; note = Homo sapiens protein tyrosine kinase 2 (PTK2), transcript variant 67, non-coding RNA, NCBI Reference Sequence: NR_148039.2
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 457 - RNA, 524 nt, Homo sapiens
  source 1..524: mol_type = unassigned RNA; note = Homo sapiens protein tyrosine kinase 2 (PTK2), transcript variant 137, non-coding RNA, NCBI Reference Sequence: NR_170670.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccaggttcaagcaattgccctgcctcagcctcccgaatagctgggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaaggtaacagttattaaaagtaaatgtttacattaaaagtttgccagttttcaaa

SEQ ID NO: 458 - RNA, 4134 nt, Homo sapiens
  source 1..4134: mol_type = unassigned RNA; note = Homo sapiens protein tyrosine kinase 2 (PTK2), transcript variant 138, non-coding RNA, NCBI Reference Sequence: NR_170671.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 459 - RNA, 4301 nt, Homo sapiens
  source 1..4301: mol_type = unassigned RNA; note = Homo sapiens protein tyrosine kinase 2 (PTK2), transcript variant 139, non-coding RNA, NCBI Reference Sequence: NR_170672.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 460 - RNA, 4511 nt, Homo sapiens
  source 1..4511: mol_type = unassigned RNA; note = Homo sapiens protein tyrosine kinase 2 (PTK2), transcript variant 140, non-coding RNA, NCBI Reference Sequence: NR_170673.1
acggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccaggctagagtgcaatggcacgatctcaactcaccgcaacctccacctcctgggttcaagcgattctcctgcctcagcctcctgagtagctgggattacagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 461 - RNA, 4597 nt, Homo sapiens
  source 1..4597: mol_type = unassigned RNA; note = Homo sapiens protein tyrosine kinase 2 (PTK2), transcript variant X8, mRNA, NCBI Reference Sequence: XM_017013654.2
attgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttac

SEQ ID NO: 462 - RNA, 4591 nt, Homo sapiens
  source 1..4591: mol_type = unassigned RNA; note = Homo sapiens protein tyrosine kinase 2 (PTK2), transcript variant X10, mRNANCBI Reference Sequence: XM_017013656.2
attgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccag

SEQ ID NO: 463 - RNA, 4466 nt, Homo sapiens
  source 1..4466: mol_type = unassigned RNA; note = Homo sapiens protein tyrosine kinase 2 (PTK2), transcript variant X18, mRNA, NCBI Reference Sequence: XM_017013666.1
attgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 464 - RNA, 4415 nt, Homo sapiens
  source 1..4415: mol_type = unassigned RNA; note = Homo sapiens protein tyrosine kinase 2 (PTK2), transcript variant X19, mRNA, NCBI Reference Sequence: XM_017013669.2
agcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccag

SEQ ID NO: 465 - RNA, 4361 nt, Homo sapiens
  source 1..4361: mol_type = unassigned RNA; note = Homo sapiens protein tyrosine kinase 2 (PTK2), transcript variant X21, mRNA, NCBI Reference Sequence: XM_017013684.2
agcacggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttac

SEQ ID NO: 466 - RNA, 4271 nt, Homo sapiens
  source 1..4271: mol_type = unassigned RNA; note = Homo sapiens protein tyrosine kinase 2 (PTK2), transcript variant X23, mRNA, NCBI Reference Sequence: XM_017013688.2
agcacggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttac

SEQ ID NO: 467 - RNA, 4439 nt, Homo sapiens
  source 1..4439: mol_type = unassigned RNA; note = Homo sapiens protein tyrosine kinase 2 (PTK2), transcript variant X1, mRNA, NCBI Reference Sequence: XM_024447199.1
atccatggttggttgaatctggatgtggaacccgctgacgtggatggctgactgtattgcagaactggggctcccttgcatcttccagttacaaattcagtgccttctgcagtttccccagagctcctcaagaataacggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttac

SEQ ID NO: 468 - RNA, 4421 nt, Homo sapiens
  source 1..4421: mol_type = unassigned RNA; note = Homo sapiens protein tyrosine kinase 2 (PTK2), transcript variant X2, mRNA, NCBI Reference Sequence: XM_024447200.1
atccatggttggttgaatctggatgtggaacccgctgacgtggatggctgactgtattgcagaactggggctcccttgcatcttccagttacaaattcagtgccttctgcagtttccccagagctcctcaagaataacggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttac

SEQ ID NO: 469 - RNA, 4415 nt, Homo sapiens
  source 1..4415: mol_type = unassigned RNA; note = Homo sapiens protein tyrosine kinase 2 (PTK2), transcript variant X5, mRNA, NCBI Reference Sequence: XM_024447202.1
atccatggttggttgaatctggatgtggaacccgctgacgtggatggctgactgtattgcagaactggggctcccttgcatcttccagttacaaattcagtgccttctgcagtttccccagagctcctcaagaataacggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccag

SEQ ID NO: 470 - RNA, 4200 nt, Homo sapiens
  source 1..4200: mol_type = unassigned RNA; note = Homo sapiens protein tyrosine kinase 2 (PTK2), transcript variant X3, mRNA, NCBI Reference Sequence: XM_024447201.1
atccatggttggttgaatctggatgtggaacccgctgacgtggatggctgactgtattgcagaactggggctcccttgcatcttccagttacaaattcagtgccttctgcagtttccccagagctcctcaagaataacggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactatttta

SEQ ID NO: 471 - RNA, 4182 nt, Homo sapiens
  source 1..4182: mol_type = unassigned RNA; note = Homo sapiens protein tyrosine kinase 2 (PTK2), transcript variant X7, mRNA, NCBI Reference Sequence: XM_024447204.1
atccatggttggttgaatctggatgtggaacccgctgacgtggatggctgactgtattgcagaactggggctcccttgcatcttccagttacaaattcagtgccttctgcagtttccccagagctcctcaagaataacggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactatttta

SEQ ID NO: 472 - RNA, 4416 nt, Homo sapiens
  source 1..4416: mol_type = unassigned RNA; note = Homo sapiens protein tyrosine kinase 2 (PTK2), transcript variant X6, mRNA, NCBI Reference Sequence: XM_024447203.1
atccatggttggttgaatctggatgtggaacccgctgacgtggatggctgactgtattgcagaactggggctcccttgcatcttccagttacaaattcagtgccttctgcagtttccccagagctcctcaagaataacggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 473 - RNA, 4398 nt, Homo sapiens
  source 1..4398: mol_type = unassigned RNA; note = Homo sapiens protein tyrosine kinase 2 (PTK2), transcript variant X12, mRNA, NCBI Reference Sequence: XM_024447206.1
atccatggttggttgaatctggatgtggaacccgctgacgtggatggctgactgtattgcagaactggggctcccttgcatcttccagttacaaattcagtgccttctgcagtttccccagagctcctcaagaataacggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaata

SEQ ID NO: 474 - RNA, 4398 nt, Homo sapiens
  source 1..4398: mol_type = unassigned RNA; note = Homo sapiens protein tyrosine kinase 2 (PTK2), transcript variant X9, mRNA, NCBI Reference Sequence: XM_024447205.1
atccatggttggttgaatctggatgtggaacccgctgacgtggatggctgactgtattgcagaactggggctcccttgcatcttccagttacaaattcagtgccttctgcagtttccccagagctcctcaagaataacggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 475 - RNA, 4331 nt, Homo sapiens
  source 1..4331: mol_type = unassigned RNA; note = Homo sapiens protein tyrosine kinase 2 (PTK2), transcript variant X14, mRNA, NCBI Reference Sequence: XM_024447208.1
atccatggttggttgaatctggatgtggaacccgctgacgtggatggctgactgtattgcagaactggggctcccttgcatcttccagttacaaattcagtgccttctgcagtttccccagagctcctcaagaataacggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttac

SEQ ID NO: 476 - RNA, 4359 nt, Homo sapiens
  source 1..4359: mol_type = unassigned RNA; note = Homo sapiens protein tyrosine kinase 2 (PTK2), transcript variant X13, mRNA, NCBI Reference Sequence: XM_024447207.1
atccatggttggttgaatctggatgtggaacccgctgacgtggatggctgactgtattgcagaactggggctcccttgcatcttccagttacaaattcagtgccttctgcagtttccccagagctcctcaagaataacggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaata

SEQ ID NO: 477 - RNA, 4290 nt, Homo sapiens
  source 1..4290: mol_type = unassigned RNA; note = Homo sapiens protein tyrosine kinase 2 (PTK2), transcript variant X16, mRNA, NCBI Reference Sequence: XM_024447210.1
atccatggttggttgaatctggatgtggaacccgctgacgtggatggctgactgtattgcagaactggggctcccttgcatcttccagttacaaattcagtgccttctgcagtttccccagagctcctcaagaataacggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaata

SEQ ID NO: 478 - RNA, 4313 nt, Homo sapiens
  source 1..4313: mol_type = unassigned RNA; note = Homo sapiens protein tyrosine kinase 2 (PTK2), transcript variant X15, mRNA, NCBI Reference Sequence: XM_024447209.1
atccatggttggttgaatctggatgtggaacccgctgacgtggatggctgactgtattgcagaactggggctcccttgcatcttccagttacaaattcagtgccttctgcagtttccccagagctcctcaagaataacggaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttac

SEQ ID NO: 479 - RNA, 4477 nt, Homo sapiens
  source 1..4477: mol_type = unassigned RNA; note = Homo sapiens protein tyrosine kinase 2 (PTK2), transcript variant X20, mRNA, NCBI Reference Sequence: XM_024447211.1
gagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattgcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaattagtggggacgaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttac

SEQ ID NO: 480 - RNA, 2594 nt, Homo sapiens
  source 1..2594: mol_type = unassigned RNA; note = Homo sapiens CEA cell adhesion molecule 6 (CEACAM6), mRNA, NCBI Reference Sequence: NM_002483.7
acagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggaagtgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacagtcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtgtcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataactaaa

SEQ ID NO: 481 - RNA, 2478 nt, Homo sapiens
  source 1..2478: mol_type = unassigned RNA; note = Homo sapiens CEA cell adhesion molecule 6 (CEACAM6), transcript variant X1, mRNA, NCBI Reference Sequence: XM_011526990.2
cacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctgattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacagtcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtgtcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataactaaa

SEQ ID NO: 482 - RNA, 1668 nt, Homo sapiens
  source 1..1668: mol_type = unassigned RNA; note = Homo sapiens C-X-C motif chemokine receptor 4 (CXCR4), transcript variant 2, mRNA, NCBI Reference Sequence: NM_003467.3
agtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaactta

SEQ ID NO: 483 - RNA, 1904 nt, Homo sapiens
  source 1..1904: mol_type = unassigned RNA; note = Homo sapiens C-X-C motif chemokine receptor 4 (CXCR4), transcript variant 1, mRNA, NCBI Reference Sequence: NM_001008540.2
cttccctctagtgggcggggcagaggagttagccaagatgtgactttgaaaccctcagcgtctcagtgcccttttgttctaaacaaagaattttgtaattggttctaccaaagaaggatataatgaagtcactatgggaaaagatggggaggagagttgtaggattctacattaattctcttgtgcccttagcccactacttcagaatttcctgaagaaagcaagcctgaattggttttttaaattgctttaaaaattttttttaactgggttaatgcttgctgaattggaagtgaatgtccattcctttgcctcttttgcagatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttaaaaaaaaaaaaaaaaaa

SEQ ID NO: 484 - RNA, 1881 nt, Homo sapiens
  source 1..1881: mol_type = unassigned RNA; note = Homo sapiens C-X-C motif chemokine receptor 4 (CXCR4), transcript variant 3, mRNA, NCBI Reference Sequence: NM_001348056.2
agtttgttggctgcggcagcaggtagcaaagtgacgccgagggcctgagtgctccagtagccaccgcatctggagaaccagcggttaccatggaggggatcagtgaaaatgccccgctccctaacgtcccaaacgcgccaagtgataaacacgaggatggcaagagacccacacaccggaggagcgcccgcttgggggaggaggtgccgtttgttcattttctgacactcccgcccaatataccccaagcaccgaagggccttcgttttaagaccgcattctctttacccactacaagttgcttgaagcccagaatgatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaactta

SEQ ID NO: 485 - RNA, 1767 nt, Homo sapiens
  source 1..1767: mol_type = unassigned RNA; note = Homo sapiens C-X-C motif chemokine receptor 4 (CXCR4), transcript variant 4, mRNA, NCBI Reference Sequence: NM_001348059.2
agtttgttggctgcggcagcaggtagcaaagtgacgccgagggcctgagtgctccagtagccaccgcatctggagaaccagcggttaccatggaggggatcagtgaaaatgccccgctccctaacgtcccaaacgcgccaagtgataaacacgaggatggcaagagacccacacaccggaggagcgcccgcttgggggaggagatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaactta

SEQ ID NO: 486 - RNA, 1905 nt, Homo sapiens
  source 1..1905: mol_type = unassigned RNA; note = Homo sapiens C-X-C motif chemokine receptor 4 (CXCR4), transcript variant 5, mRNA, NCBI Reference Sequence: NM_001348060.2
agcaggattggaatctttttctctgtgagtcgaggagaaacgactggaaagagcgttccagtggctgcatgtgtctcccccttgagtcccgccgcgcgcggcggcttgcacgctgtttgcaaacgtaagaacattctgtgcacaagtgcagagaaggcgtgcgcgctgcctcgggactcagaccaccggtctcttccttggggaagcggggatgtcttggagcgagttacattgtctgaatttagaggcggagggcggcgtgcctgggctgagttcccaggaggagattgcgcccgctttaacttcggggttaagcgcctggtgactgttcttgacactggatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaactta

SEQ ID NO: 487 - RNA, 3661 nt, Homo sapiens
  source 1..3661: mol_type = unassigned RNA; note = Homo sapiens catenin beta 1 (CTNNB1), transcript variant 1, mRNA, NCBI Reference Sequence: NM_001904.4
aagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattc

SEQ ID NO: 488 - RNA, 3356 nt, Homo sapiens
  source 1..3356: mol_type = unassigned RNA; note = Homo sapiens catenin beta 1 (CTNNB1), transcript variant 2, mRNA, NCBI Reference Sequence: NM_001098209.2
aagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattc

SEQ ID NO: 489 - RNA, 3197 nt, Homo sapiens
  source 1..3197: mol_type = unassigned RNA; note = Homo sapiens catenin beta 1 (CTNNB1), transcript variant 3, mRNA, NCBI Reference Sequence: NM_001098210.2
aagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattc

SEQ ID NO: 490 - RNA, 3488 nt, Homo sapiens
  source 1..3488: mol_type = unassigned RNA; note = Homo sapiens catenin beta 1 (CTNNB1), transcript variant 4, mRNA, NCBI Reference Sequence: NM_001330729.2
aagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaaggctaccttttgctccattttctgctcactcctcctaatggcttggtgaaatagcaaacaagccaccagcaggaatctagtctggatgactgcttctggagcctggatgcagtaccattcttccactgattcactgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattc

SEQ ID NO: 491 - RNA, 3878 nt, Homo sapiens
  source 1..3878: mol_type = unassigned RNA; note = Homo sapiens catenin beta 1 (CTNNB1), transcript variant X5, mRNA, NCBI Reference Sequence: XM_006712983.2
ggaacgctccgcgctgcgccggtggcggcaggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaaggctaccttttgctccattttctgctcactcctcctaatggcttggtgaaatagcaaacaagccaccagcaggaatctagtctggatgactgcttctggagcctggatgcagtaccattcttccactgattcactgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 492 - RNA, 3104 nt, Homo sapiens
  source 1..3104: mol_type = unassigned RNA; note = Homo sapiens catenin beta 1 (CTNNB1), transcript variant X8, mRNA, NCBI Reference Sequence: XM_006712985.1
ataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 493 - RNA, 3267 nt, Homo sapiens
  source 1..3267: mol_type = unassigned RNA; note = Homo sapiens catenin beta 1 (CTNNB1), transcript variant X3, mRNA, NCBI Reference Sequence: XM_017005738.1
aagtcccatcagtcctggggatcggaccagtggactttctcttaagatttcctctttcattcttaagaatagaagtgttattattttttttaatgccctggctatgtgagtttgaatcgaagcaactttaaaccttagagcaactaaactctaagtgcagcgggtgcgatgcgtcagtagggtgagcacataaaaaatccatgtcttgcacctgtattttagcgtactatgcagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 494 - RNA, 3594 nt, Homo sapiens
  source 1..3594: mol_type = unassigned RNA; note = Homo sapiens catenin beta 1 (CTNNB1), transcript variant X1, mRNA, NCBI Reference Sequence: XM_024453356.1
ggagccaaacttcgtagcaggcgcgcggtccgggcggcgggctgggcgcagccgggaggcctggggttgggagcggggagctcagagcaggtacaagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 495 - RNA, 3374 nt, Homo sapiens
  source 1..3374: mol_type = unassigned RNA; note = Homo sapiens catenin beta 1 (CTNNB1), transcript variant X2, mRNA, NCBI Reference Sequence: XM_024453357.1
tctttcattcttaagaatagaagtgttattattttttttaatgccctggctatgtgagtttgaatcgaagcaactttaaaccttagagcaactaaactctaagtgcagcgggtgcgatgcgtcagtagggtgagcacataaaaaatccatgtcttgcacctgtattttagcgtactatgcagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 496 - RNA, 3130 nt, Homo sapiens
  source 1..3130: mol_type = unassigned RNA; note = Homo sapiens catenin beta 1 (CTNNB1), transcript variant X4, mRNA, NCBI Reference Sequence: XM_024453358.1
ggagccaaacttcgtagcaggcgcgcggtccgggcggcgggctgggcgcagccgggaggcctggggttgggagcggggagctcagagcaggtacaagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 497 - RNA, 3941 nt, Homo sapiens
  source 1..3941: mol_type = unassigned RNA; note = Homo sapiens catenin beta 1 (CTNNB1), transcript variant X6, mRNA, NCBI Reference Sequence: XM_024453359.1
gggtggggacggggggctccgccttctcagctcttgcggcgagttggggttcgggcgctgaggcagagacgccaccctaagtcccatcagtcctggggatcggaccagtggactttctcttaagatttcctctttcattcttaagaatagaagtgttattattttttttaatgccctggctatgtgagtttgaatcgaagcaactttaaaccttagagcaactaaactctaagtgcagcgggtgcgatgcgtcagtagggtgagcacataaaaaatccatgtcttgcacctgtattttagcgtactatgcagggtatttgaagtataccatacaactgttttgaaaatccagcgtggacaatggctactcaaggctaccttttgctccattttctgctcactcctcctaatggcttggtgaaatagcaaacaagccaccagcaggaatctagtctggatgactgcttctggagcctggatgcagtaccattcttccactgattcactgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 498 - RNA, 3375 nt, Homo sapiens
  source 1..3375: mol_type = unassigned RNA; note = Homo sapiens catenin beta 1 (CTNNB1), transcript variant X7, mRNA, NCBI Reference Sequence: XM_024453360.1
ggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaaggctaccttttgctccattttctgctcactcctcctaatggcttggtgaaatagcaaacaagccaccagcaggaatctagtctggatgactgcttctggagcctggatgcagtaccattcttccactgattcactgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 499 - RNA, 6881 nt, Homo sapiens
  source 1..6881: mol_type = unassigned RNA; note = Homo sapiens BCL2 apoptosis regulator (BCL2), transcript variant alpha, mRNA, NCBI Reference Sequence: NM_000633.3
acccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 500 - RNA, 1595 nt, Homo sapiens
  source 1..1595: mol_type = unassigned RNA; note = Homo sapiens BCL2 apoptosis regulator (BCL2), transcript variant beta, mRNA, NCBI Reference Sequence: NM_000657.3
acccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcacttggtgatgtgagtctgggctgaggccacaggtccgagatgcgggggttggagtgcgggtgggctcctggggcaatgggaggctgtggagccggcgaaataaaatcagagttgttgct

SEQ ID NO: 501 - RNA, 2554 nt, Homo sapiens
  source 1..2554: mol_type = unassigned RNA; note = Homo sapiens BCL2 apoptosis regulator (BCL2), transcript variant X2, mRNA, NCBI Reference Sequence: XM_011526135.3
ccgccgcgctgccgccgccgccgctgccagcgaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaagtaagttctctgcacaggaaattggtttaatgtaactttcaatggaaacctttgagattttttacttaaagtgcattcgagtaaatttaatttccaggcagcttaatacattctttttagccgtgttacttgtagtgtgtatgccctgctttcactcagtgtgtacagggaaacgcacctgattttttacttattagtttgttttttctttaacctttcagcatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcccttgtgttatttgcagggctaagggagtttcagcatgggccaggaaactactttcttaaaagaaacttaaacgcgaaattctgacaagataggaaactcttactgcatccttactaaacctctttttcccccctactttctcatttatttatatatctcttgtgttatgaaacatatataggttgaatatttaactcactctgaattcatgtgcagaataagtcactcttcagaaggacaaaaataatgttttaagtggtttgtttaataaagcacatattaaaaaatttcaattcaacatcttccctgggcacaacatgttatgactttttagagtagagcttcgtggtatttcataaggaagccaaaaaggaagggaaattattattcgggcagagggacaatagtgacctttcattaagcaagacagagttcaccatcaggctccccaaaccccaggctctgtgttagttgaactgaacaagccaccaactatttcctctctctctttctctctttctctctcttttttttttttttgagaaggagttttgctcttgttgccca

SEQ ID NO: 502 - RNA, 4026 nt, Homo sapiens
  source 1..4026: mol_type = unassigned RNA; note = Homo sapiens BCL2 apoptosis regulator (BCL2), transcript variant X3, mRNA, NCBI Reference Sequence: XM_017025917.2
gggggcggtcgggtggctcagaggagggctctttctttcttctttttttgaatgaaccgtgtgacgttacgcacaggaaaccggtcgggctgtgcagagaatgaagtaagaggacaggcaccacagccccgctcccgcccccttcctcccgcgcccgcccctccgcgccgcctgcccgcccgcccgccgcgctcccgcccgccgctctccgtggccccgccgcgctgccgccgccgccgctgccagcgaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctggctttacatgtgacctcttagttctagagtttgatctcaggagaagggaagagtagatttggattctgtgccgtggacaggcgcactggtttcccgtgtgaaaaggacaaagccccgccccttctggagctcagttctctttgggattattcataatgttctccaagaagctcggagtgcctgtttgtcgccagtactgtaatttgtgagtaaaagatctttatgattgcaaaatacattagcgccttcggagatcattgtttcttgatgacggtgtgaatcacaactaggaactaggaagtcatttcagccccttctgtgcagagggatgtcatgaagtacatatgctaaagttcatacccattgctcataagagctcagccaaccttctcaaccagttcatgtaaaaatatatctgtataaatatgcatacgtatgtatgtatgtggtgtgtgtgtgagttaagatatacataaaatttacgttttccaccaattttaaatgtatagttcagtggctttcagcacatttactttgttacataaaccattattatgtaagccattactgacatctgtttccagaacttgttcatcattccaaatggaaactctacccattaaactataactccctgtttctttttctccccagtcctaggtagccactattctattttctgtctctataaatttgactcttcgaggaagaatttgattcttcccataagtggaatcagacaatatttgtccttttgtgtctagcttgttttatctaacatattttcagagttcacccatgtcatggcatgcatcagaatttcattcctttttaaggctgaataatattccataccatttgcttttttaaaagtccattttctcaaaaaattggttgtcatttccactccccacccagccaatagaaacagcaaatatattaaattagaattgacctgacagaggaggtaatggaggcctgtaaattattcaaagaattattttagagtctgacagcaaggaagaagacaaaaatgctcttaaaaccagctcaggagtctctgaggctcttctgcgtggggcaggcagtcacaaagatctctacggctcctggagttctcgctggatcgtagcacaggacaatcttagtgattcctaatgatgccactgagtcatcaagacagagttattttctgtaggaagagtcaaagagttcagggaaagtgagtagtaagttacagaaatatctccattccaaatggttaaaattttttaaaagtttaggcttcagtcatctgaaaaatttacttgtgtgaaatgattcagtccagactgtagtgaaagagaggaatcccagcaatatcaaagtaaaatacacacacacacacacacacacacacagagagagagagagaaggagcacaagatctctttcttttttgtttttttctctttttttttgaacaaactcttacatatccttcaagcccaggccaaatggcaccttctctgtgaatgtgtgtgtgttaaataggcagagagaccttcaggggcgtttgctgacttctttcattctttttcatctcctacctccctttctagagtagagaattagtaggaacttgactcaagtggacggggatgtaatttctagggggagtttttgctgtcttactgcatctaaattattctgtctgtgcataaattaagttgtacacatatttagaagagccacctcccccactgcaggatgcatagagtggtttttgtgaggagctgctttgcagcctcaactctgcctcctgacttcattttgaaaccactgtacaataaaacgtggtcatttgtttgttccacattctttgtgcctactgggtttctggacatgatctctggccttgggggggacagtctcctggggaaacagacacacaaacagatctattacagtccagtgagttttttcctgggaaagttaaggatggtttcacagagaaggtgccgtttggcctgggcttgaaggatacataagagtttgttcaaaaaaaaaaa

SEQ ID NO: 503 - RNA, 2343 nt, Homo sapiens
  source 1..2343: mol_type = unassigned RNA; note = Homo sapiens BCL2 apoptosis regulator (BCL2), transcript variant X1, misc_RNA, NCBI Reference Sequence: XR_935248.3
gagggggcggtcgggtggctcagaggagggctctttctttcttctttttttgaatgaaccgtgtgacgttacgcacaggaaaccggtcgggctgtgcagagaatgaagtaagaggacaggcaccacagccccgctcccgcccccttcctcccgcgcccgcccctccgcgccgcctgcccgcccgcccgccgcgctcccgcccgccgctctccgtggccccgccgcgctgccgccgccgccgctgccagcgaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctggacagaaactcaggatctgttcaacagtaatgcctgttcccccacgcctgcagccttggcaaccaccatactactgcctgcctctatgaacttgactactctaggtacctcgcataagtggactcacacttgtgactggcttgttacactaagcatgatgtcttcaaggttcatccatgttttggcctgtgtcacagcttccttcattttgaaggctgaatgatattccattgaatggatctactacatattgtttctccgttcatttattgatggatacttgagctgcttccccttttggactaatgtgaataatgctgctatgaacggatgcctttgtggaactgtacggccccagcatgcggc

SEQ ID NO: 504 - RNA, 2574 nt, Homo sapiens
  source 1..2574: mol_type = unassigned RNA; note = Homo sapiens BCL2 like 1 (BCL2L1), transcript variant 1, mRNA, NCBI Reference Sequence: NM_138578.3
ctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 505 - RNA, 2385 nt, Homo sapiens
  source 1..2385: mol_type = unassigned RNA; note = Homo sapiens BCL2 like 1 (BCL2L1), transcript variant 2, mRNA, NCBI Reference Sequence: NM_001191.4
ctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 506 - RNA, 2556 nt, Homo sapiens
  source 1..2556: mol_type = unassigned RNA; note = Homo sapiens BCL2 like 1 (BCL2L1), transcript variant 3, mRNA, NCBI Reference Sequence: NM_001317919.2
ctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 507 - RNA, 2405 nt, Homo sapiens
  source 1..2405: mol_type = unassigned RNA; note = Homo sapiens BCL2 like 1 (BCL2L1), transcript variant 4, mRNA, NCBI Reference Sequence: NM_001317920.2
gccgcggcaccggaagtgactgagcttgcaagttcccctgtctcttcaggggaaactgaggccggcttgttcgggagagacggcgcgagcagtcagccagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 508 - RNA, 2534 nt, Homo sapiens
  source 1..2534: mol_type = unassigned RNA; note = Homo sapiens BCL2 like 1 (BCL2L1), transcript variant 5, mRNA, NCBI Reference Sequence: NM_001317921.2
gccgcggcaccggaagtgactgagcttgcaagttcccctgtctcttcaggggaaactgaggccggcttgttcgggagagacggcgcgagcagtcagccaggtaggccggcagccaggtaggccggcccgggtccgcggcgcggaactcggccgcgaagagctcttgcgtctggaagctaccgggccgatgaagggggatgtggccccccacggctcgcggggctcgcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 509 - RNA, 2423 nt, Homo sapiens
  source 1..2423: mol_type = unassigned RNA; note = Homo sapiens BCL2 like 1 (BCL2L1), transcript variant 7, mRNA, NCBI Reference Sequence: NM_001322239.2
gccgcggcaccggaagtgactgagcttgcaagttcccctgtctcttcaggggaaactgaggccggcttgttcgggagagacggcgcgagcagtcagccagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 510 - RNA, 2552 nt, Homo sapiens
  source 1..2552: mol_type = unassigned RNA; note = Homo sapiens BCL2 like 1 (BCL2L1), transcript variant 8, mRNA, NCBI Reference Sequence: NM_001322240.2
gccgcggcaccggaagtgactgagcttgcaagttcccctgtctcttcaggggaaactgaggccggcttgttcgggagagacggcgcgagcagtcagccaggtaggccggcagccaggtaggccggcccgggtccgcggcgcggaactcggccgcgaagagctcttgcgtctggaagctaccgggccgatgaagggggatgtggccccccacggctcgcggggctcgcagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 511 - RNA, 2389 nt, Homo sapiens
  source 1..2389: mol_type = unassigned RNA; note = Homo sapiens BCL2 like 1 (BCL2L1), transcript variant 9, mRNA, NCBI Reference Sequence: NM_001322242.2
actggtgctttcgatttgacttaagtgaagtatcttggaacctagacccagaccttcgtaagacccacaaagaaaccagttctgaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 512 - RNA, 2474 nt, Homo sapiens
  source 1..2474: mol_type = unassigned RNA; note = Homo sapiens BCL2 like 1 (BCL2L1), transcript variant 6, non-coding RNA, NCBI Reference Sequence: NR_134257.1
aatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggtgccagatgccagttttagattctggctccaccactgacacagctgggtgaccttgatccagtccctggaccctcagaggcacagcttcttggcctgtaaatggggagagacagcctgcattgcagaattgttgggaggattaaaggacaaattgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaacaaagaaaaaaa

SEQ ID NO: 513 - RNA, 2423 nt, Homo sapiens
  source 1..2423: mol_type = unassigned RNA; note = Homo sapiens BCL2 like 1 (BCL2L1), transcript variant X2, mRNA, NCBI Reference Sequence: XM_011528964.2
tccgaggaaggcatttcggagaagacgggggtagaaaaggctggtgggagattcagagtccactggtgctttcgatttgacttaagtgaagtatcttggaacctagacccagaccttcaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 514 - RNA, 2429 nt, Homo sapiens
  source 1..2429: mol_type = unassigned RNA; note = Homo sapiens BCL2 like 1 (BCL2L1), transcript variant X1, mRNA, NCBI Reference Sequence: XM_017027993.1
atttcggagaagacgggggtagaaaaggctggtgggagattcagagtccactggtgctttcgatttgacttaagtgaagtatcttggaacctagacccagaccttcctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 515 - RNA, 2731 nt, Homo sapiens
  source 1..2731: mol_type = unassigned RNA; note = Homo sapiens BCL2 like 1 (BCL2L1), transcript variant X3, misc_RNA, NCBI Reference Sequence: XR_936599.3
ctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggtgccagatgccagttttagattctggctccaccactgacacagctgggtgaccttgatccagtccctggaccctcagaggcacagcttcttggcctgtaaatggggagagacagcctgcattgcagaattgttgggaggattaaaggacaaattgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 516 - RNA, 2713 nt, Homo sapiens
  source 1..2713: mol_type = unassigned RNA; note = Homo sapiens BCL2 like 1 (BCL2L1), transcript variant X4, misc_RNA, NCBI Reference Sequence: XR_001754364.2
ctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggtgccagatgccagttttagattctggctccaccactgacacagctgggtgaccttgatccagtccctggaccctcagaggcacagcttcttggcctgtaaatggggagagacagcctgcattgcagaattgttgggaggattaaaggacaaattgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 517 - RNA, 607 nt, Homo sapiens
  source 1..607: mol_type = unassigned RNA; note = Homo sapiens somatostatin (SST), mRNA, NCBI Reference Sequence: NM_001048.4
acaagccgctttaggagcgaggttcggagccatcgctgctgcctgctgatccgcgcctagagtttgaccagccactctccagctcggctttcgcggcgccgagatgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggaactggccaagtacttcttggcagagctgctgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttagctttcttaactagtattgtccatatcagacctctgatccctcgcccccacaccccatctctcttccctaatcctccaagtcttcagcgagacccttgcattagaaactgaaaactgtaaatacaaaataaaattatggtgaaattatgaaaaa

SEQ ID NO: 518 - RNA, 3251 nt, Homo sapiens
  source 1..3251: mol_type = unassigned RNA; note = Homo sapiens Raf-1 proto-oncogene, serine/threonine kinase (RAF1), transcript variant 1, mRNA, NCBI Reference Sequence: NM_001354689.3
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgagaataacaacctgagtgcttctcccagggcgtggtccagacgattttgtttgaggggaagagatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 519 - RNA, 3191 nt, Homo sapiens
  source 1..3191: mol_type = unassigned RNA; note = Homo sapiens Raf-1 proto-oncogene, serine/threonine kinase (RAF1), transcript variant 2, mRNA, NCBI Reference Sequence: NM_002880.4
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 520 - RNA, 3026 nt, Homo sapiens
  source 1..3026: mol_type = unassigned RNA; note = Homo sapiens Raf-1 proto-oncogene, serine/threonine kinase (RAF1), transcript variant 3, mRNA, NCBI Reference Sequence: NM_001354690.3
agagctgccccatatctgttgtcacttggatgggccaattccttttctcttgggccgccgaatgtgggacccgggcttgcaccctttctcagggtacttcagtcaagtgacacccttttagagacgacgtgaggaatcgggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 521 - RNA, 3171 nt, Homo sapiens
  source 1..3171: mol_type = unassigned RNA; note = Homo sapiens Raf-1 proto-oncogene, serine/threonine kinase (RAF1), transcript variant 4, mRNA, NCBI Reference Sequence: NM_001354691.3
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcagacggggtcttggtatgtttcccagagctggtgttaaactcctgggctcaagtagtcctcccatctcagccttccagagtcctgggatttgcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtgtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 522 - RNA, 3078 nt, Homo sapiens
  source 1..3078: mol_type = unassigned RNA; note = Homo sapiens Raf-1 proto-oncogene, serine/threonine kinase (RAF1), transcript variant 5, mRNA, NCBI Reference Sequence: NM_001354692.3
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtgtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 523 - RNA, 3092 nt, Homo sapiens
  source 1..3092: mol_type = unassigned RNA; note = Homo sapiens Raf-1 proto-oncogene, serine/threonine kinase (RAF1), transcript variant 6, mRNA, NCBI Reference Sequence: NM_001354693.3
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 524 - RNA, 3138 nt, Homo sapiens
  source 1..3138: mol_type = unassigned RNA; note = Homo sapiens Raf-1 proto-oncogene, serine/threonine kinase (RAF1), transcript variant 7, mRNA, NCBI Reference Sequence: NM_001354694.3
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtgtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgagaataacaacctgagtgcttctcccagggcgtggtccagacgattttgtttgaggggaagagatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 525 - RNA, 2979 nt, Homo sapiens
  source 1..2979: mol_type = unassigned RNA; note = Homo sapiens Raf-1 proto-oncogene, serine/threonine kinase (RAF1), transcript variant 8, mRNA, NCBI Reference Sequence: NM_001354695.3
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtgtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 526 - RNA, 3304 nt, Homo sapiens
  source 1..3304: mol_type = unassigned RNA; note = Homo sapiens Raf-1 proto-oncogene, serine/threonine kinase (RAF1), transcript variant 9, non-coding RNA, NCBI Reference Sequence: NR_148940.3
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggattagctgtgggtgtccctatcaaacagggaaggcattgacttaattcttgaatctatgtggaatattaatgttctgattttaatggaaacactttgtcacttggaagaaaggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 527 - RNA, 3250 nt, Homo sapiens
  source 1..3250: mol_type = unassigned RNA; note = Homo sapiens Raf-1 proto-oncogene, serine/threonine kinase (RAF1), transcript variant 10, non-coding RNA, NCBI Reference Sequence: NR_148941.3
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggttatttgaaagactgagatcattcaactgattgcactgactgccaactaattttgcaggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 528 - RNA, 3189 nt, Homo sapiens
  source 1..3189: mol_type = unassigned RNA; note = Homo sapiens Raf-1 proto-oncogene, serine/threonine kinase (RAF1), transcript variant 11, non-coding RNA, NCBI Reference Sequence: NR_148942.3
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattgcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 529 - RNA, 3284 nt, Homo sapiens
  source 1..3284: mol_type = unassigned RNA; note = Homo sapiens Raf-1 proto-oncogene, serine/threonine kinase (RAF1), transcript variant X1, mRNA, NCBI Reference Sequence: XM_011533974.3
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcagacggggtcttggtatgtttcccagagctggtgttaaactcctgggctcaagtagtcctcccatctcagccttccagagtcctgggatttgcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 530 - RNA, 2880 nt, Homo sapiens
  source 1..2880: mol_type = unassigned RNA; note = Homo sapiens Raf-1 proto-oncogene, serine/threonine kinase (RAF1), transcript variant X2, mRNA, NCBI Reference Sequence: XM_017006966.1
aaatggggtcttgctgtgttgaccaggctggtcttgaactcttggcctcaagctgtcctcccatctgggcctcccaaagtgctgggattacaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 531 - RNA, 1518 nt, Homo sapiens
  source 1..1518: mol_type = unassigned RNA; note = Homo sapiens Raf-1 proto-oncogene, serine/threonine kinase (RAF1), transcript variant X3, misc_RNA, NCBI Reference Sequence: XR_001740227.1
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggttatttgaaagactgagatcattcaactgattgcactgactgccaactaattttgcaggagatgttgcagtaaagatcctaaaggttgtcgacccaaccccagagcaattccaggccttcaggaatgaggtggctgttctgcgcaaaacacggcatgtgaacattctgcttttcatg

SEQ ID NO: 532 - RNA, 3715 nt, Homo sapiens
  source 1..3715: mol_type = unassigned RNA; note = Homo sapiens S-phase kinase associated protein 2 (SKP2), transcript variant 1, mRNA, NCBI Reference Sequence: NM_005983.4
agtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatgaagtatttattgcaggatggtgtctcttctttagaacagggaaaataggcaggaagcccaattgctggagtacttagctagttttattcttggttttccctttgccttcattctgcaagtatactagggagccatttgagagggaaaactatgaaatcttgctttttgaaatgattctaaaagcttctatcactgctttgctcttaagagccaaagttgtaggccttttgaaattttaggagagtgagcctataatttcaagataccttaaagagcaaaatttgagccacctcttccaagtgcccttcttactaagtctattcagaatcaagcttaaaaattaccaccagcaaacaatcttcatagcccatataacttttatctatttaattttatagtattgctttataagacagcttagaagaacaataagctatttgtattatgagctgaacaaaaagagaatcataggatagtagcgtctgaggccatcttttctaggaataggaaagagaaaaatgtatttgaattttgcctttagatttgaaattaggttaatagaaataagtaaccccatgtaattcaccttaaaacttaacaaaagaccaaacattacaaaacccagagatatagaatcaatataggatttgaaggcccagcagacagttttctatgacaggttaatctgaagtatcctgtaatgttcattaagttactgtgtttccagaatctaaattagatgagaaatataattgtggttttctaacttgataatcaaattatgttaacatgggtcctttagcttttaaaatgacttgctttgttttagaaaggtggtattaatccactctctattcttgaaaatttggatgggagaattctgaagttgcctgctgttttcctttagcgctgaggttcttaaggttacttttatattactctggaatcaagtattttaaattgtattttttttttaaatgatctctcagcaataattgtttgaaactatccatatataaggttatcagacctacagttccctaagaggaactgcatgttctcttcaatcagaaatatacagtagaagcaggtatatcttccatgcagtttcagtagtaagcactacttatacctacataagagttaaaatccagatgtgggaccttttgataccatcagtgatatatatttttttaaactggtacagagaagtgaaaagattaaattctacttctattttttttttttttttttgagacggagtctcgctctgtcaccaaggccggagtgcagtggtgcgatctcggctcactgcaagctccgcctcccaggttcacgtcattctcctgcctcagcctcccgactagctgggactacaggcgcccaccaccacgcccggctaatttttttgtatttttagtagagacggggtttcaccatgttagccaggatggtctcaatctcctgacctcatgatccgcccgtcttggcctcccaaagtgctgggattacaggcatgagcaactgcgcccagccaaattctacttcttaaaaatcacaaaaactagtttaaattgatgacttgttcgtatgttcaaaatgtaacaacaaaaaaagctaacaccagtcatttatattaactttttttttttaaatcaaaaattgttaatgttagaaacatactatgaagtgcctttatctgcttagacctaaggaagattttaaagttgggttgcacaggaaatgatgatgcttcaatttcttaatagttaaaaagtgctaaatactacttgaaattattgtttacagattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaactaagttgtattccttttttctttctctttttttaagtgctgtggttaaaatttgaaagcatttagtgtggtatgccatttggcttagatacctctaaataagactcttcaaaacagagccctgagatggtcctttttgacccatctacttcatatgcttgtcacattaaaaaaaaaagtttataatgcctttataaaaggggctaatacagtcttgttatctttttttttaaattatactttaagttctagggtacatgtgcacaacgtgcaggttt

SEQ ID NO: 533 - RNA, 1403 nt, Homo sapiens
  source 1..1403: mol_type = unassigned RNA; note = Homo sapiens S-phase kinase associated protein 2 (SKP2), transcript variant 2, mRNA, NCBI Reference Sequence: NM_032637.4
agtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttactattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaa

SEQ ID NO: 534 - RNA, 3468 nt, Homo sapiens
  source 1..3468: mol_type = unassigned RNA; note = Homo sapiens S-phase kinase associated protein 2 (SKP2), transcript variant 3, mRNA, NCBI Reference Sequence: NM_001243120.2
agtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagtactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatgaagtatttattgcaggatggtgtctcttctttagaacagggaaaataggcaggaagcccaattgctggagtacttagctagttttattcttggttttccctttgccttcattctgcaagtatactagggagccatttgagagggaaaactatgaaatcttgctttttgaaatgattctaaaagcttctatcactgctttgctcttaagagccaaagttgtaggccttttgaaattttaggagagtgagcctataatttcaagataccttaaagagcaaaatttgagccacctcttccaagtgcccttcttactaagtctattcagaatcaagcttaaaaattaccaccagcaaacaatcttcatagcccatataacttttatctatttaattttatagtattgctttataagacagcttagaagaacaataagctatttgtattatgagctgaacaaaaagagaatcataggatagtagcgtctgaggccatcttttctaggaataggaaagagaaaaatgtatttgaattttgcctttagatttgaaattaggttaatagaaataagtaaccccatgtaattcaccttaaaacttaacaaaagaccaaacattacaaaacccagagatatagaatcaatataggatttgaaggcccagcagacagttttctatgacaggttaatctgaagtatcctgtaatgttcattaagttactgtgtttccagaatctaaattagatgagaaatataattgtggttttctaacttgataatcaaattatgttaacatgggtcctttagcttttaaaatgacttgctttgttttagaaaggtggtattaatccactctctattcttgaaaatttggatgggagaattctgaagttgcctgctgttttcctttagcgctgaggttcttaaggttacttttatattactctggaatcaagtattttaaattgtattttttttttaaatgatctctcagcaataattgtttgaaactatccatatataaggttatcagacctacagttccctaagaggaactgcatgttctcttcaatcagaaatatacagtagaagcaggtatatcttccatgcagtttcagtagtaagcactacttatacctacataagagttaaaatccagatgtgggaccttttgataccatcagtgatatatatttttttaaactggtacagagaagtgaaaagattaaattctacttctattttttttttttttttttgagacggagtctcgctctgtcaccaaggccggagtgcagtggtgcgatctcggctcactgcaagctccgcctcccaggttcacgtcattctcctgcctcagcctcccgactagctgggactacaggcgcccaccaccacgcccggctaatttttttgtatttttagtagagacggggtttcaccatgttagccaggatggtctcaatctcctgacctcatgatccgcccgtcttggcctcccaaagtgctgggattacaggcatgagcaactgcgcccagccaaattctacttcttaaaaatcacaaaaactagtttaaattgatgacttgttcgtatgttcaaaatgtaacaacaaaaaaagctaacaccagtcatttatattaactttttttttttaaatcaaaaattgttaatgttagaaacatactatgaagtgcctttatctgcttagacctaaggaagattttaaagttgggttgcacaggaaatgatgatgcttcaatttcttaatagttaaaaagtgctaaatactacttgaaattattgtttacagattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaactaagttgtattccttttttctttctctttttttaagtgctgtggttaaaatttgaaagcatttagtgtggtatgccatttggcttagatacctctaaataagactcttcaaaacagagccctgagatggtcctttttgacccatctacttcatatgcttgtcacattaaaaaaaaaagtttataatgcctttataaaaggggctaatacagtcttgttatctttttttttaaattatactttaagttctagggtacatgtgcacaacgtgcaggttt

SEQ ID NO: 535 - RNA, 3814 nt, Homo sapiens
  source 1..3814: mol_type = unassigned RNA; note = Homo sapiens S-phase kinase associated protein 2 (SKP2), transcript variant X1, mRNA, NCBI Reference Sequence: XM_011514082.3
agtgcggccgcgaagcagagcgggctgtagagccttgcgcgcgcagtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttactcatccagaactcctaggagcttctagcgtctacccaaaaaggcttctttgtcatccattctttcctgtccttgccatctggcctcctgcttctttgcctgtgcagccccctggggagtgtggtgatcattctttttgggttgcttttctcaagagaatctatccatgtgtcttgcttttgttccttctctgcagaaagaaagaagctaagcaggtaatgacccaaatgctttttctcaagcagaggcgaggggaaggctgtgagctcttcattttaatatttttatccagtgggataatagtaatagtaattgcgatacctgcataataatggcatggtaatacttggaggcagtgtgaattgatagttacaaacacgggtctgaagtcacagacctgttgtgaaccttcactgtattattatttcttatttgtacaaatcttatgaaataagacaaacaggggcattaggagtttagttacaagtcagaccactagaatagagaagaagaaagatcctgtccttgaacattaaggtaaagagtatatttctttaggtattgtgtaaatagtacactgatttgcattgtgaatcctttaggatgagtttgttggtaccttatgcttaaaagtttcttgagataaaataagaattagaatgactctaatttcaatcattttggcagctgatatatttgaggtttataataaaaattccaggatgtttccataataatttcaagagagccatctatgctaaagaacttaaggctatttatttctcggaagtgggaaaatacaatttgaatgtctttcttctgtaatattttaaaatacttgggaaactataaagttttcttccccaggacctattcccattatatttattcccttacttcttaattggtcttcttctctatgtctaaacttccttctaattcttccctatttctcattcaagtaagaaacccaagctggaggtagtaaactaatctaagataagactaaaagacttctgtggtaggagcatttgtagttgaggcatttaagattttataaggaaaacaggattattgtacagataaggtaaggagcaatcctgtgaaagagttcataaatatcttttattttctaaaattcaatatacataagacattggtgtgattttacatttcttacattagaaataatggctcttgaactacttatttctatttgctatcccttagtttgctcttcagtctcttccattgtagtttttaaaagatgcttgcaaattttttattctgagttgtaggtaatgcacataccgggggcatttttttttttttgtctccttaaaattttagagactttctggatttttgacttggaactggttcttcatccatcatcttatcttatataacccccttatatataacacccgggtgtgttctgagagtctgttcttaatttctttcctcaccaaatctctttcccaatgctgttgcaagaacatgtcctcctctgccatctgccattcctccttttcttactccacctacagtttcttcccttaaatattctccagtgcagaatggctcacaatttggctaatttggatataccagaaccagaattctcatagtaattacaacgtttcccaagtttcacatgagggattcaaagttggagctggattgctgtcatcgtaagtgattaagtataagtatctgtgtatactgtgatcttacttcgacagtgtttctacattccagaaagcagtttacttaatgacagcaatttgttctttctgattttctttggttatatacctttagatcttattgtccccttgtgaacaagcatatttatttcccttggataatgcttttattttataaattagccttcatcttgtactcagctaacgtatattaaacatttgtggggtttaagacaccttgtagaatgtagaataaatacatttaggggagtagtgggaagactggaagagcaggttaaacacggaaggtcttcagactagctgaacagcctgggttctgtaaacacaagggaagcatcaaaggttttggagcagatgaatgactaacatgagctaggctttaggaggatgccttggaaattggtatatagaataggctagaaggaagaaagacagttataaggaaagtttggggctttttaaaaataattattgacaatgtgaaaatataaaggatgtttctgactttaggtaattgatgtgctcattgatctgtagtaggattttgttgaaattccaaaataaatgttccctttcctgagactttgtactgtatgtcccaaccttgagcaaacagagatgagagagatgaatttctaggcacatagatctgagttaagaaggaaaaaatcattaccaacaccaaacagtatttactttggaaaaacagaatttgtgaaacagaatttgagaaacagaatttgtgaaacagaatttcactgttaacagggttgaatttcatctaatgtgaaatacctaaagggactggcttatctatgcagaaaaaaaa

SEQ ID NO: 536 - RNA, 3309 nt, Homo sapiens
  source 1..3309: mol_type = unassigned RNA; note = Homo sapiens S-phase kinase associated protein 2 (SKP2), transcript variant X3, mRNA, NCBI Reference Sequence: XM_011514083.3
aacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatgaagtatttattgcaggatggtgtctcttctttagaacagggaaaataggcaggaagcccaattgctggagtacttagctagttttattcttggttttccctttgccttcattctgcaagtatactagggagccatttgagagggaaaactatgaaatcttgctttttgaaatgattctaaaagcttctatcactgctttgctcttaagagccaaagttgtaggccttttgaaattttaggagagtgagcctataatttcaagataccttaaagagcaaaatttgagccacctcttccaagtgcccttcttactaagtctattcagaatcaagcttaaaaattaccaccagcaaacaatcttcatagcccatataacttttatctatttaattttatagtattgctttataagacagcttagaagaacaataagctatttgtattatgagctgaacaaaaagagaatcataggatagtagcgtctgaggccatcttttctaggaataggaaagagaaaaatgtatttgaattttgcctttagatttgaaattaggttaatagaaataagtaaccccatgtaattcaccttaaaacttaacaaaagaccaaacattacaaaacccagagatatagaatcaatataggatttgaaggcccagcagacagttttctatgacaggttaatctgaagtatcctgtaatgttcattaagttactgtgtttccagaatctaaattagatgagaaatataattgtggttttctaacttgataatcaaattatgttaacatgggtcctttagcttttaaaatgacttgctttgttttagaaaggtggtattaatccactctctattcttgaaaatttggatgggagaattctgaagttgcctgctgttttcctttagcgctgaggttcttaaggttacttttatattactctggaatcaagtattttaaattgtattttttttttaaatgatctctcagcaataattgtttgaaactatccatatataaggttatcagacctacagttccctaagaggaactgcatgttctcttcaatcagaaatatacagtagaagcaggtatatcttccatgcagtttcagtagtaagcactacttatacctacataagagttaaaatccagatgtgggaccttttgataccatcagtgatatatatttttttaaactggtacagagaagtgaaaagattaaattctacttctattttttttttttttttttgagacggagtctcgctctgtcaccaaggccggagtgcagtggtgcgatctcggctcactgcaagctccgcctcccaggttcacgtcattctcctgcctcagcctcccgactagctgggactacaggcgcccaccaccacgcccggctaatttttttgtatttttagtagagacggggtttcaccatgttagccaggatggtctcaatctcctgacctcatgatccgcccgtcttggcctcccaaagtgctgggattacaggcatgagcaactgcgcccagccaaattctacttcttaaaaatcacaaaaactagtttaaattgatgacttgttcgtatgttcaaaatgtaacaacaaaaaaagctaacaccagtcatttatattaactttttttttttaaatcaaaaattgttaatgttagaaacatactatgaagtgcctttatctgcttagacctaaggaagattttaaagttgggttgcacaggaaatgatgatgcttcaatttcttaatagttaaaaagtgctaaatactacttgaaattattgtttacagattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgc

SEQ ID NO: 537 - RNA, 1277 nt, Homo sapiens
  source 1..1277: mol_type = unassigned RNA; note = Homo sapiens S-phase kinase associated protein 2 (SKP2), transcript variant X4, mRNA, NCBI Reference Sequence: XM_017009753.1
gctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttactattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatga

SEQ ID NO: 538 - RNA, 1556 nt, Homo sapiens
  source 1..1556: mol_type = unassigned RNA; note = Homo sapiens S-phase kinase associated protein 2 (SKP2), transcript variant X2, misc_RNA, NCBI Reference Sequence: XR_001742203.2
agtgcggccgcgaagcagagcgggctgtagagccttgcgcgcgcagtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttactcatccagaactcctaggagcttctagcgtctacccaaaaaggcttctttgtcatccattctttcctgtccttgccatctggcctcctgcttctttgcctgtgcagccccctggggagtgtggtgatcattctttttgggttgcttttctcaagagaatctatccatgtgtcttgcttttgttccttctctgcagaaagaaagaagctaagcagattagtgacaagagctggggttaggatccggttggactctgacatcggatgccctcaaacatacagaacttccaaactcaagtcca

SEQ ID NO: 539 - RNA, 1368 nt, Homo sapiens
  source 1..1368: mol_type = unassigned RNA; note = Homo sapiens plasminogen activator, urokinase receptor (PLAUR), transcript variant 1, mRNA, NCBI Reference Sequence: NM_002659.4
aggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtgga

SEQ ID NO: 540 - RNA, 1257 nt, Homo sapiens
  source 1..1257: mol_type = unassigned RNA; note = Homo sapiens plasminogen activator, urokinase receptor (PLAUR), transcript variant 2, mRNA, NCBI Reference Sequence: NM_001005376.3
aggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaacacattgtgtgcctatatcaaaacatcatggaaggacaggcacagtggctcatgcctgtagtcctagcactttgggagggtgagaaaggaagatctcttgagctcaggagttcaagatcagcctgggcaacacagtgagacctcatctccactaaaaataaaaaaaaattggctgga

SEQ ID NO: 541 - RNA, 1233 nt, Homo sapiens
  source 1..1233: mol_type = unassigned RNA; note = Homo sapiens plasminogen activator, urokinase receptor (PLAUR), transcript variant 3, mRNA, NCBI Reference Sequence: NM_001005377.3
aggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagtcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtgga

SEQ ID NO: 542 - RNA, 1221 nt, Homo sapiens
  source 1..1221: mol_type = unassigned RNA; note = Homo sapiens plasminogen activator, urokinase receptor (PLAUR), transcript variant 4, mRNA, NCBI Reference Sequence: NM_001301037.2
aggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaaaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtgga

SEQ ID NO: 543 - RNA, 1156 nt, Homo sapiens
  source 1..1156: mol_type = unassigned RNA; note = Homo sapiens plasminogen activator, urokinase receptor (PLAUR), transcript variant X3, mRNA, NCBI Reference Sequence: XM_005258990.5
acaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacggatgtggacatttttgccatggaaaagtggaattccggctgggtgcggtggctgaagcttgtactctcagcactttgggaggctgaggccggaggatctcttgaggccaggagtttgagaccagcctgggcaacatagcaagacccccatctctacaaaaagaaaaatggaattctttggtggatttctcgtgggttgtggggatttgctgaagacatcttgggctttcatcctgtggtgtcctggaaaggtctctgtattccagtggttctcaaactttttggtctcaacttcttcatgcttttaaaaattatttttggccagg

SEQ ID NO: 544 - RNA, 1229 nt, Homo sapiens
  source 1..1229: mol_type = unassigned RNA; note = Homo sapiens plasminogen activator, urokinase receptor (PLAUR), transcript variant X2, mRNA, NCBI Reference Sequence: XM_011527027.2
ggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaaggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggc

SEQ ID NO: 545 - RNA, 1422 nt, Homo sapiens
  source 1..1422: mol_type = unassigned RNA; note = Homo sapiens plasminogen activator, urokinase receptor (PLAUR), transcript variant X4, mRNA, NCBI Reference Sequence: XM_011527028.3
acaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaagtaaggaacgggagacacagtcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggc

SEQ ID NO: 546 - RNA, 1130 nt, Homo sapiens
  source 1..1130: mol_type = unassigned RNA; note = Homo sapiens plasminogen activator, urokinase receptor (PLAUR), transcript variant X5, mRNA, NCBI Reference Sequence: XM_011527029.2
acaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaagtaaggaacgggagacacagtcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaaca

SEQ ID NO: 547 - RNA, 1093 nt, Homo sapiens
  source 1..1093: mol_type = unassigned RNA; note = Homo sapiens plasminogen activator, urokinase receptor (PLAUR), transcript variant X6, mRNA, NCBI Reference Sequence: XM_011527030.2
ggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggcca

SEQ ID NO: 548 - RNA, 1277 nt, Homo sapiens
  source 1..1277: mol_type = unassigned RNA; note = Homo sapiens plasminogen activator, urokinase receptor (PLAUR), transcript variant X7, mRNA, NCBI Reference Sequence: XM_011527031.3
acaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaagtaaggaacgggagacacagaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggcca

SEQ ID NO: 549 - RNA, 1786 nt, Homo sapiens
  source 1..1786: mol_type = unassigned RNA; note = Homo sapiens plasminogen activator, urokinase receptor (PLAUR), transcript variant X1, mRNA, NCBI Reference Sequence: XM_017026872.2
ttcgcgggaaactagagtatctaacaatagaaactccggagggctgatggggccgggcctagaatttgggaataaattagtgggccgggagaggctctggagccgggtagaaccagggggagtgagtggagggatagttccattagggcactgggagtgacggtataacataaagatcgacgcgggtggggcaaggctagaacgtccccagcagaactggagaggcgtaatcgaccgagggccggtgcggtgagaaagacctaataggagcaggaatagaacgtactgatagagagggcggggatacgactgtcaggatatacgcctcacgaggacagaatgaaaggaaaaacgggccaaggcaggactttgggaaaggacttgtgggcagggatagaacgttcagttagtggggtggaggtagaacgtggacaacggacagactggaagtaccgccggccggaacccagcagaacatggacacgaatctgaatggacggggcctggagacttggtcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggc

SEQ ID NO: 550 - RNA, 1439 nt, Homo sapiens
  source 1..1439: mol_type = unassigned RNA; note = Homo sapiens plasminogen activator, urokinase receptor (PLAUR), transcript variant X8, mRNA, NCBI Reference Sequence: XM_017026873.1
aaaagaaagaaaggagaaacttgaggcgctacaatctctgaaataacagaagtgtagaatttgggttccacagacaacctggctttttcccggagcgcacttgccaatctgctgctgtggaagggaaatagagcccagacggaaagagagtcgctagactgagaagacggaggttggagtttggggctgccagaatgtctggaagatgagagttaaaatcctggaatggatgggaccacagaaaagggagttcccaacctgcaaacaaatctccctcaagtcattggcaagctctacatgcacagggtgagagtccaagaaacttggaagagaaaaatagcaactgggaagctacaaaagcgaacaaggcttccagcagacatgtgatgctggggacacaggttgccaagctgaagaggccttggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggc

SEQ ID NO: 551 - RNA, 7490 nt, Homo sapiens
  source 1..7490: mol_type = unassigned RNA; note = Homo sapiens MDM2 proto-oncogene (MDM2), transcript variant 1, mRNA, NCBI Reference Sequence: NM_002392.6
gggcgcgcaccgaggcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtct

SEQ ID NO: 552 - RNA, 12239 nt, Homo sapiens
  source 1..12239: mol_type = unassigned RNA; note = Homo sapiens MDM2 proto-oncogene (MDM2), transcript variant 3, mRNA, NCBI Reference Sequence: NM_001145337.3
agtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagctctcctttaaagactttaaaaaaaattcgataggcattttcatgtttcagtcctacaatcccacatctctgctgccttcagaatgctacaacttagatgtccagccaacagcttaaagccaatttataaaaatagcatctttcctaattccaaaatttcaccttttgtttgttttgttttgagatgcggtcttgctctgtcgcccaggctggaatgcagtgctgcaaacatgactcactacagcctcaacctcctgggctcaagcaatcctcccacctcagcctcccaagtagctggggaccacaggtgcaagccaccaggtccagctaaccttccccccacctcccccgaccccgctgccacccgccctgagacagagtcttgctctttcacccagactggagtgcagtggtgcaatctcggctcattgcaacctccacctcccaggttcaagcaattctgcctcagcctcctgagtagctggaattataggtgctcgccaaccacacctggctaattttttttgtatttttagtagagatggggtttcagcatgttgtccaggctggtctcgaactcctgacctcatgatccgcccacctcggcctcccaaagtactgggattacaggcgtgagccaccgtgcccggcctaatttttgtattttttgtagagacagtttcaccatgttgcccaggctggtctcaaactcctggggtcaagtgatctgcccgtcttggcttcccaaagtgctgagattacaggtgtaagccaccacgccaagcccaaaatttcaccttttaaatttattccatttattttgtaggtgaatttcatttatttctcagggttaaattttagcgcttttgcctgtgtctatttttggttcacacctccccagcccactgtcctgtattaagtaggccttccttcaagatcacagtaatatctccctaaatggatttcactacgtttggtcctatttttggttcagttatagtttacagataccatcatgttgcttccctgatttaaatattgggggaaaaacttgctttttggattttatctctgatgttctactggattattttagacttttagaacactatgaaatgggtgcttgcttttcacttttcaaaccttttttgcttaaacaaagttcataagcttattgtagtgggaagttcaaagtcacagatctggtacttactcgcctagtgaccttagagacaataaatctatagagcctagtatggggtctggcaggtagtaagcacttttaatgaatggaagtttaatattctgtttgcatccactcgaccataatcaccccaaatccagcttaggtagccttgaattaacccctactccaccttgaagttttttatttgttttttgctgagacagggtctcattctgtcacccaggctggagtatagtggcgcaaacatgactcactgcagcctcctgagtagctgggaacacaggcctgttgccaccatgcctggctaatatatatattatatataatatacatatattacatatatatatataatacatatgtgtttatgtatgtatgtgtgtgtacattatatatatatatatactttttttagaggcagagtcctgctatgttgcccaggctggccttgaactcctgggctcaagcaatcctcgtgtcttgaccttgacctctcaaaatgctgggattacaggtgcgagccactgcatctggtgaattaagccttttttatacactcaactctgaggtattctgttcataccaatatgttcctttgtatcttcttgccatagcaggttgtaacatccttttgtatctcctttctttttttttttttttttttgagacggagtcccgctgtttagcccaggccggattgcagtggcgcaatctcggctcactgcaagctccgcctcccaggttcacgccattctcctgcctcagcctcccgagtagctgggactacaggcgcccgccaccgcgcctggctaattttttgtatttttagtagagacggggtttcaccgtgttagccaagatggtctcgatctcctgaccttgtgatccgcccgcctcggcctcccaaagtgctgggattacaggcgtgagccaccgcgcccagccgtatctcctttcaaatgtcaaataaatacattgtgtatacagtagtaaaggatgttgattggcattgaaagcaactatcaagttcttgttgatttagaagacaaaaagacaattttaaaataacatcctgggccaggctctgtgactcacgcctgtaatctcaacactttgggaggccaaggaaggaggatcacttgaggccaggagtttgagatcagcctgggcaacataatgacaccctgtatccaaaaaattgtggtggcatgcatgggagactgaggtgggaggatcacttgagcccaggagtccaatgttacaatgagctatgattgcgccactacactctgcttaggagacagatggagacttgtctcttaaaaaaataaaaaataacagtatgttcattaaacattaatctcactgattgtgattttttgtttgtttttttgagatggcgtcttgctctgttgcccagggtggagtgcaatggcgtgatcttggctcactgcagcctccacctcctgggttcaagtgattctcctgctttagcctcccaagtagctgtgttatttcagctaattttttcatttttagtggagatggggttttgccatgttggccaggctggtctcgaattcctgacctcatgtggtccacctgcctcggcctcccaaagtgctgggattacaggcattgagccactgtgcctggcctgattatgattttttaaagtccccccccaaattattgtttgtgcaataaatggcaaaaaagaagcattctaagaaaaaagtagtcttaaaagttgatatggtgtcagaattgtaagagagagggtcttggctgaaaagcctttttagaaaaaattgctccctacaaaaaaggccttttctaccttttctcacatttgtttctttttataggaggcatctgagaagaccaaatctcttcaaagttaagctttttgtttttttgggggggacgaagtctcgttctgtcacccaggctggagtgtagtggcatgatctcggctcactgcaacctctgcctcctgggttcaagcaattctcctgcctcagcctcccgagtagctggaaattcaggcgcctgccaccatgcccagctaatttttgtatttttaatagaggcagggtttcactatattggccaggctggtctcgaactcctgacctcatgatccgcctgcctctgcctcccaaagtgttgggattacaggcatgagccaccgcacccagcccaaagttaagcattttttaaccacaaggtgggaggtggaagtatctcgttggaagactaaaggtgtccactaacggtagacccttttttttttttttttgagatggagtttcactgtcgcccagactagactgaagtggcgcgatctcggctcactgcaacctctgccccccaggttcaagtgattctcctgcctcagcctctagagtagctaggattacaggggtccaccaccacacctggctagtttttgtattttcagtagagacggggtttcaccatgttggccaggctggtctcgaactcctgacctcaggtgacccacctgctttggcctcccaaagtgctgggattacaggtgtgagccactgcgcctggccgtttttttttttgttgttgttgttgtttgttcgtttgtttgttttgagacagtctctcactccaggttggagtgcagtggcactatctcagctcactgcaaactctgcctcccaaggtcaaatgattctcctgcctcagcctcccagtagttggaattacaggcgcatgccaccatgcatggctaattttttgtatttttagtagagacggggtttcaccatgctagccttgaactcctgaccttgtgatctgcctgcctcggcctcccaaagtgctgggattacagacatgagccaccatgctagccttgaactcctgacctcgtgatctgcctgcctcggcctcccaaagtgctgggattacagacatgagccaccatgcctggcaaatttttgtattttcagtagagatggggttttgctatgttagccaggctagtctcgaactcctgacctcaggtgatccagtcgcctcggcctcccaaagtgctgggattacagatgtgagtcactacgcttggtagactcttaacagcgctgagagaccactccaagagagcagagaaataatagttctattctcagttgtcaaacagcaaacaaaaaacccttggctggggggtgatggctcacccctgtaatcccagcactttgggaggctgaggtgggtggatcacttgaggccaggaattcaagaccaacctgggcaacatggtgcaaccctgtcttaactaaaaatacaaaaattagccaggcgtcatggcatgtgcctgttaattccagctgctcgagaggctgaggcatgagaattacttgaacctgggaggtggaggttgcagtgagccgagatcccaccactgcactccagcctgggtgacagagcgagacttcgtcccaaaaaaaaaaaaaaaagctgcaaatttaaacgttgaagtctaggtaaatataccagggaacttctgcttaagaggcttctatgtaatgaaattctcttgaaaacagagaaactatttcctgtttattttctaaattgagacgtcactttttaaaaattggtacctgtaatttagccatttcctactcagcaatgtctcatttaaactattatttgtttagcgtgtttcaaagagcagatgtaagcttgagcccatcctctgtcctatgactaagtcgatattagcaggggttaggactgttagttttccagttcctactggaggcaaattctttgtttaccactgttctctgtatttcaaaagcacctggaaatcaataaaatttgttattcagaacaaaa

SEQ ID NO: 553 - RNA, 7330 nt, Homo sapiens
  source 1..7330: mol_type = unassigned RNA; note = Homo sapiens MDM2 proto-oncogene (MDM2), transcript variant 2, mRNA, NCBI Reference Sequence: NM_001145339.2
gtagggggcgcgcaccgaggcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtct

SEQ ID NO: 554 - RNA, 11792 nt, Homo sapiens
  source 1..11792: mol_type = unassigned RNA; note = Homo sapiens MDM2 proto-oncogene (MDM2), transcript variant 4, mRNA, NCBI Reference Sequence: NM_001145340.3
agtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagctctcctttaaagactttaaaaaaaattcgataggcattttcatgtttcagtcctacaatcccacatctctgctgccttcagaatgctacaacttagatgtccagccaacagcttaaagccaatttataaaaatagcatctttcctaattccaaaatttcaccttttgtttgttttgttttgagatgcggtcttgctctgtcgcccaggctggaatgcagtgctgcaaacatgactcactacagcctcaacctcctgggctcaagcaatcctcccacctcagcctcccaagtagctggggaccacaggtgcaagccaccaggtccagctaaccttccccccacctcccccgaccccgctgccacccgccctgagacagagtcttgctctttcacccagactggagtgcagtggtgcaatctcggctcattgcaacctccacctcccaggttcaagcaattctgcctcagcctcctgagtagctggaattataggtgctcgccaaccacacctggctaattttttttgtatttttagtagagatggggtttcagcatgttgtccaggctggtctcgaactcctgacctcatgatccgcccacctcggcctcccaaagtactgggattacaggcgtgagccaccgtgcccggcctaatttttgtattttttgtagagacagtttcaccatgttgcccaggctggtctcaaactcctggggtcaagtgatctgcccgtcttggcttcccaaagtgctgagattacaggtgtaagccaccacgccaagcccaaaatttcaccttttaaatttattccatttattttgtaggtgaatttcatttatttctcagggttaaattttagcgcttttgcctgtgtctatttttggttcacacctccccagcccactgtcctgtattaagtaggccttccttcaagatcacagtaatatctccctaaatggatttcactacgtttggtcctatttttggttcagttatagtttacagataccatcatgttgcttccctgatttaaatattgggggaaaaacttgctttttggattttatctctgatgttctactggattattttagacttttagaacactatgaaatgggtgcttgcttttcacttttcaaaccttttttgcttaaacaaagttcataagcttattgtagtgggaagttcaaagtcacagatctggtacttactcgcctagtgaccttagagacaataaatctatagagcctagtatggggtctggcaggtagtaagcacttttaatgaatggaagtttaatattctgtttgcatccactcgaccataatcaccccaaatccagcttaggtagccttgaattaacccctactccaccttgaagttttttatttgttttttgctgagacagggtctcattctgtcacccaggctggagtatagtggcgcaaacatgactcactgcagcctcctgagtagctgggaacacaggcctgttgccaccatgcctggctaatatatatattatatataatatacatatattacatatatatatataatacatatgtgtttatgtatgtatgtgtgtgtacattatatatatatatatactttttttagaggcagagtcctgctatgttgcccaggctggccttgaactcctgggctcaagcaatcctcgtgtcttgaccttgacctctcaaaatgctgggattacaggtgcgagccactgcatctggtgaattaagccttttttatacactcaactctgaggtattctgttcataccaatatgttcctttgtatcttcttgccatagcaggttgtaacatccttttgtatctcctttctttttttttttttttttttgagacggagtcccgctgtttagcccaggccggattgcagtggcgcaatctcggctcactgcaagctccgcctcccaggttcacgccattctcctgcctcagcctcccgagtagctgggactacaggcgcccgccaccgcgcctggctaattttttgtatttttagtagagacggggtttcaccgtgttagccaagatggtctcgatctcctgaccttgtgatccgcccgcctcggcctcccaaagtgctgggattacaggcgtgagccaccgcgcccagccgtatctcctttcaaatgtcaaataaatacattgtgtatacagtagtaaaggatgttgattggcattgaaagcaactatcaagttcttgttgatttagaagacaaaaagacaattttaaaataacatcctgggccaggctctgtgactcacgcctgtaatctcaacactttgggaggccaaggaaggaggatcacttgaggccaggagtttgagatcagcctgggcaacataatgacaccctgtatccaaaaaattgtggtggcatgcatgggagactgaggtgggaggatcacttgagcccaggagtccaatgttacaatgagctatgattgcgccactacactctgcttaggagacagatggagacttgtctcttaaaaaaataaaaaataacagtatgttcattaaacattaatctcactgattgtgattttttgtttgtttttttgagatggcgtcttgctctgttgcccagggtggagtgcaatggcgtgatcttggctcactgcagcctccacctcctgggttcaagtgattctcctgctttagcctcccaagtagctgtgttatttcagctaattttttcatttttagtggagatggggttttgccatgttggccaggctggtctcgaattcctgacctcatgtggtccacctgcctcggcctcccaaagtgctgggattacaggcattgagccactgtgcctggcctgattatgattttttaaagtccccccccaaattattgtttgtgcaataaatggcaaaaaagaagcattctaagaaaaaagtagtcttaaaagttgatatggtgtcagaattgtaagagagagggtcttggctgaaaagcctttttagaaaaaattgctccctacaaaaaaggccttttctaccttttctcacatttgtttctttttataggaggcatctgagaagaccaaatctcttcaaagttaagctttttgtttttttgggggggacgaagtctcgttctgtcacccaggctggagtgtagtggcatgatctcggctcactgcaacctctgcctcctgggttcaagcaattctcctgcctcagcctcccgagtagctggaaattcaggcgcctgccaccatgcccagctaatttttgtatttttaatagaggcagggtttcactatattggccaggctggtctcgaactcctgacctcatgatccgcctgcctctgcctcccaaagtgttgggattacaggcatgagccaccgcacccagcccaaagttaagcattttttaaccacaaggtgggaggtggaagtatctcgttggaagactaaaggtgtccactaacggtagacccttttttttttttttttgagatggagtttcactgtcgcccagactagactgaagtggcgcgatctcggctcactgcaacctctgccccccaggttcaagtgattctcctgcctcagcctctagagtagctaggattacaggggtccaccaccacacctggctagtttttgtattttcagtagagacggggtttcaccatgttggccaggctggtctcgaactcctgacctcaggtgacccacctgctttggcctcccaaagtgctgggattacaggtgtgagccactgcgcctggccgtttttttttttgttgttgttgttgtttgttcgtttgtttgttttgagacagtctctcactccaggttggagtgcagtggcactatctcagctcactgcaaactctgcctcccaaggtcaaatgattctcctgcctcagcctcccagtagttggaattacaggcgcatgccaccatgcatggctaattttttgtatttttagtagagacggggtttcaccatgctagccttgaactcctgaccttgtgatctgcctgcctcggcctcccaaagtgctgggattacagacatgagccaccatgctagccttgaactcctgacctcgtgatctgcctgcctcggcctcccaaagtgctgggattacagacatgagccaccatgcctggcaaatttttgtattttcagtagagatggggttttgctatgttagccaggctagtctcgaactcctgacctcaggtgatccagtcgcctcggcctcccaaagtgctgggattacagatgtgagtcactacgcttggtagactcttaacagcgctgagagaccactccaagagagcagagaaataatagttctattctcagttgtcaaacagcaaacaaaaaacccttggctggggggtgatggctcacccctgtaatcccagcactttgggaggctgaggtgggtggatcacttgaggccaggaattcaagaccaacctgggcaacatggtgcaaccctgtcttaactaaaaatacaaaaattagccaggcgtcatggcatgtgcctgttaattccagctgctcgagaggctgaggcatgagaattacttgaacctgggaggtggaggttgcagtgagccgagatcccaccactgcactccagcctgggtgacagagcgagacttcgtcccaaaaaaaaaaaaaaaagctgcaaatttaaacgttgaagtctaggtaaatataccagggaacttctgcttaagaggcttctatgtaatgaaattctcttgaaaacagagaaactatttcctgtttattttctaaattgagacgtcactttttaaaaattggtacctgtaatttagccatttcctactcagcaatgtctcatttaaactattatttgtttagcgtgtttcaaagagcagatgtaagcttgagcccatcctctgtcctatgactaagtcgatattagcaggggttaggactgttagttttccagttcctactggaggcaaattctttgtttaccactgttctctgtatttcaaaagcacctggaaatcaataaaatttgttattcagaacaaaa

SEQ ID NO: 555 - RNA, 11870 nt, Homo sapiens
  source 1..11870: mol_type = unassigned RNA; note = Homo sapiens MDM2 proto-oncogene (MDM2), transcript variant 5, mRNA, NCBI Reference Sequence: NM_001278462.2
agtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagctctcctttaaagactttaaaaaaaattcgataggcattttcatgtttcagtcctacaatcccacatctctgctgccttcagaatgctacaacttagatgtccagccaacagcttaaagccaatttataaaaatagcatctttcctaattccaaaatttcaccttttgtttgttttgttttgagatgcggtcttgctctgtcgcccaggctggaatgcagtgctgcaaacatgactcactacagcctcaacctcctgggctcaagcaatcctcccacctcagcctcccaagtagctggggaccacaggtgcaagccaccaggtccagctaaccttccccccacctcccccgaccccgctgccacccgccctgagacagagtcttgctctttcacccagactggagtgcagtggtgcaatctcggctcattgcaacctccacctcccaggttcaagcaattctgcctcagcctcctgagtagctggaattataggtgctcgccaaccacacctggctaattttttttgtatttttagtagagatggggtttcagcatgttgtccaggctggtctcgaactcctgacctcatgatccgcccacctcggcctcccaaagtactgggattacaggcgtgagccaccgtgcccggcctaatttttgtattttttgtagagacagtttcaccatgttgcccaggctggtctcaaactcctggggtcaagtgatctgcccgtcttggcttcccaaagtgctgagattacaggtgtaagccaccacgccaagcccaaaatttcaccttttaaatttattccatttattttgtaggtgaatttcatttatttctcagggttaaattttagcgcttttgcctgtgtctatttttggttcacacctccccagcccactgtcctgtattaagtaggccttccttcaagatcacagtaatatctccctaaatggatttcactacgtttggtcctatttttggttcagttatagtttacagataccatcatgttgcttccctgatttaaatattgggggaaaaacttgctttttggattttatctctgatgttctactggattattttagacttttagaacactatgaaatgggtgcttgcttttcacttttcaaaccttttttgcttaaacaaagttcataagcttattgtagtgggaagttcaaagtcacagatctggtacttactcgcctagtgaccttagagacaataaatctatagagcctagtatggggtctggcaggtagtaagcacttttaatgaatggaagtttaatattctgtttgcatccactcgaccataatcaccccaaatccagcttaggtagccttgaattaacccctactccaccttgaagttttttatttgttttttgctgagacagggtctcattctgtcacccaggctggagtatagtggcgcaaacatgactcactgcagcctcctgagtagctgggaacacaggcctgttgccaccatgcctggctaatatatatattatatataatatacatatattacatatatatatataatacatatgtgtttatgtatgtatgtgtgtgtacattatatatatatatatactttttttagaggcagagtcctgctatgttgcccaggctggccttgaactcctgggctcaagcaatcctcgtgtcttgaccttgacctctcaaaatgctgggattacaggtgcgagccactgcatctggtgaattaagccttttttatacactcaactctgaggtattctgttcataccaatatgttcctttgtatcttcttgccatagcaggttgtaacatccttttgtatctcctttctttttttttttttttttttgagacggagtcccgctgtttagcccaggccggattgcagtggcgcaatctcggctcactgcaagctccgcctcccaggttcacgccattctcctgcctcagcctcccgagtagctgggactacaggcgcccgccaccgcgcctggctaattttttgtatttttagtagagacggggtttcaccgtgttagccaagatggtctcgatctcctgaccttgtgatccgcccgcctcggcctcccaaagtgctgggattacaggcgtgagccaccgcgcccagccgtatctcctttcaaatgtcaaataaatacattgtgtatacagtagtaaaggatgttgattggcattgaaagcaactatcaagttcttgttgatttagaagacaaaaagacaattttaaaataacatcctgggccaggctctgtgactcacgcctgtaatctcaacactttgggaggccaaggaaggaggatcacttgaggccaggagtttgagatcagcctgggcaacataatgacaccctgtatccaaaaaattgtggtggcatgcatgggagactgaggtgggaggatcacttgagcccaggagtccaatgttacaatgagctatgattgcgccactacactctgcttaggagacagatggagacttgtctcttaaaaaaataaaaaataacagtatgttcattaaacattaatctcactgattgtgattttttgtttgtttttttgagatggcgtcttgctctgttgcccagggtggagtgcaatggcgtgatcttggctcactgcagcctccacctcctgggttcaagtgattctcctgctttagcctcccaagtagctgtgttatttcagctaattttttcatttttagtggagatggggttttgccatgttggccaggctggtctcgaattcctgacctcatgtggtccacctgcctcggcctcccaaagtgctgggattacaggcattgagccactgtgcctggcctgattatgattttttaaagtccccccccaaattattgtttgtgcaataaatggcaaaaaagaagcattctaagaaaaaagtagtcttaaaagttgatatggtgtcagaattgtaagagagagggtcttggctgaaaagcctttttagaaaaaattgctccctacaaaaaaggccttttctaccttttctcacatttgtttctttttataggaggcatctgagaagaccaaatctcttcaaagttaagctttttgtttttttgggggggacgaagtctcgttctgtcacccaggctggagtgtagtggcatgatctcggctcactgcaacctctgcctcctgggttcaagcaattctcctgcctcagcctcccgagtagctggaaattcaggcgcctgccaccatgcccagctaatttttgtatttttaatagaggcagggtttcactatattggccaggctggtctcgaactcctgacctcatgatccgcctgcctctgcctcccaaagtgttgggattacaggcatgagccaccgcacccagcccaaagttaagcattttttaaccacaaggtgggaggtggaagtatctcgttggaagactaaaggtgtccactaacggtagacccttttttttttttttttgagatggagtttcactgtcgcccagactagactgaagtggcgcgatctcggctcactgcaacctctgccccccaggttcaagtgattctcctgcctcagcctctagagtagctaggattacaggggtccaccaccacacctggctagtttttgtattttcagtagagacggggtttcaccatgttggccaggctggtctcgaactcctgacctcaggtgacccacctgctttggcctcccaaagtgctgggattacaggtgtgagccactgcgcctggccgtttttttttttgttgttgttgttgtttgttcgtttgtttgttttgagacagtctctcactccaggttggagtgcagtggcactatctcagctcactgcaaactctgcctcccaaggtcaaatgattctcctgcctcagcctcccagtagttggaattacaggcgcatgccaccatgcatggctaattttttgtatttttagtagagacggggtttcaccatgctagccttgaactcctgaccttgtgatctgcctgcctcggcctcccaaagtgctgggattacagacatgagccaccatgctagccttgaactcctgacctcgtgatctgcctgcctcggcctcccaaagtgctgggattacagacatgagccaccatgcctggcaaatttttgtattttcagtagagatggggttttgctatgttagccaggctagtctcgaactcctgacctcaggtgatccagtcgcctcggcctcccaaagtgctgggattacagatgtgagtcactacgcttggtagactcttaacagcgctgagagaccactccaagagagcagagaaataatagttctattctcagttgtcaaacagcaaacaaaaaacccttggctggggggtgatggctcacccctgtaatcccagcactttgggaggctgaggtgggtggatcacttgaggccaggaattcaagaccaacctgggcaacatggtgcaaccctgtcttaactaaaaatacaaaaattagccaggcgtcatggcatgtgcctgttaattccagctgctcgagaggctgaggcatgagaattacttgaacctgggaggtggaggttgcagtgagccgagatcccaccactgcactccagcctgggtgacagagcgagacttcgtcccaaaaaaaaaaaaaaaagctgcaaatttaaacgttgaagtctaggtaaatataccagggaacttctgcttaagaggcttctatgtaatgaaattctcttgaaaacagagaaactatttcctgtttattttctaaattgagacgtcactttttaaaaattggtacctgtaatttagccatttcctactcagcaatgtctcatttaaactattatttgtttagcgtgtttcaaagagcagatgtaagcttgagcccatcctctgtcctatgactaagtcgatattagcaggggttaggactgttagttttccagttcctactggaggcaaattctttgtttaccactgttctctgtatttcaaaagcacctggaaatcaataaaatttgttattcagaacaaaa

SEQ ID NO: 556 - RNA, 7131 nt, Homo sapiens
  source 1..7131: mol_type = unassigned RNA; note = Homo sapiens MDM2 proto-oncogene (MDM2), transcript variant 6, mRNA, NCBI Reference Sequence: NM_001367990.1
tgtgttcagtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaag

SEQ ID NO: 557 - RNA, 6964 nt, Homo sapiens
  source 1..6964: mol_type = unassigned RNA; note = Homo sapiens MDM2 proto-oncogene (MDM2), transcript variant X2, mRNA, NCBI Reference Sequence: XM_006719399.4
caggttaagaacttctgcactagagatacatgagtacagtatactgatctttctgggatagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaag

SEQ ID NO: 558 - RNA, 7270 nt, Homo sapiens
  source 1..7270: mol_type = unassigned RNA; note = Homo sapiens MDM2 proto-oncogene (MDM2), transcript variant X3, mRNA, NCBI Reference Sequence: XM_006719400.4
gacccgcgcgctcccctcgggcggtagggggcgcgcaccgaggcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaag

SEQ ID NO: 559 - RNA, 2436 nt, Homo sapiens
  source 1..2436: mol_type = unassigned RNA; note = Homo sapiens RAD51 recombinase (RAD51), transcript variant 1, mRNA, NCBI Reference Sequence: NM_002875.5
aattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacca

SEQ ID NO: 560 - RNA, 2439 nt, Homo sapiens
  source 1..2439: mol_type = unassigned RNA; note = Homo sapiens RAD51 recombinase (RAD51), transcript variant 2, mRNA, NCBI Reference Sequence: NM_133487.4
aattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctgacggagtctcgctctgttgccaggctggagtgcaatagcgtgatcttggtctactgcaccctccgcctctcaggttcaagtgattctcctgcctcagcctcccgagtagttgggactacaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacca

SEQ ID NO: 561 - RNA, 2335 nt, Homo sapiens
  source 1..2335: mol_type = unassigned RNA; note = Homo sapiens RAD51 recombinase (RAD51), transcript variant 4, mRNA, NCBI Reference Sequence: NM_001164269.2
aattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagctaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctgacggagtctcgctctgttgccaggctggagtgcaatagcgtgatcttggtctactgcaccctccgcctctcaggttcaagtgattctcctgcctcagcctcccgagtagttgggactacaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacca

SEQ ID NO: 562 - RNA, 2314 nt, Homo sapiens
  source 1..2314: mol_type = unassigned RNA; note = Homo sapiens RAD51 recombinase (RAD51), transcript variant 3, mRNA, NCBI Reference Sequence: NM_001164270.2
aattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacca

SEQ ID NO: 563 - RNA, 2347 nt, Homo sapiens
  source 1..2347: mol_type = unassigned RNA; note = Homo sapiens RAD51 recombinase (RAD51), transcript variant X2, mRNA, NCBI Reference Sequence: XM_006720626.3
agttggggcctccgcgcgcagtgtgaaacccggacgtggcagggcgtgtccgcgcccgaccgaccctcagctgctggggcgaaaacacaagtggacctcagtctttagaactaggggagaaacattagagcctttataggcaacacctattttatgggttcgagcgagaagtccgagatcagagcggtgtagccacagctgtttaatatcacagccagggcttccggattcctgatctgtctttccattacaccgtgcttagaaagtaccaatctccgattgccaaaacagtgttttcatcatctaatgcggaaaaccattcacatgatgcctagagaatgatctgaataatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagt

SEQ ID NO: 564 - RNA, 2049 nt, Homo sapiens
  source 1..2049: mol_type = unassigned RNA; note = Homo sapiens RAD51 recombinase (RAD51), transcript variant X1, mRNA, NCBI Reference Sequence: XM_011521857.2
cttgggagtcgtggtcttcgatctggtaaacagaagacggcaactcgtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagtgaa

SEQ ID NO: 565 - RNA, 2093 nt, Homo sapiens
  source 1..2093: mol_type = unassigned RNA; note = Homo sapiens RAD51 recombinase (RAD51), transcript variant X5, mRNA, NCBI Reference Sequence: XM_011521858.2
gtgtgaaacccggacgtggcagggcgtgtccgcgcccgaccgaccctcagctgctggggcgaaaacacaagtggacctcagtctttagaactagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagt

SEQ ID NO: 566 - RNA, 2230 nt, Homo sapiens
  source 1..2230: mol_type = unassigned RNA; note = Homo sapiens RAD51 recombinase (RAD51), transcript variant X3, mRNA, NCBI Reference Sequence: XM_011521859.2
cattagagcctttataggcaacacctattttatgggttcgagcgagaagtccgagatcagagcggtgtagccacagctgtttaatatcacagccagggcttccggattcctgatctgtctttccattacaccgtgcttagaaagtaccaatctccgattgccaaaacagtgttttcatcatctaatgcggaaaaccattcacatgatgcctagagaatgatctgaagtgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagt

SEQ ID NO: 567 - RNA, 2141 nt, Homo sapiens
  source 1..2141: mol_type = unassigned RNA; note = Homo sapiens RAD51 recombinase (RAD51), transcript variant X4, mRNA, NCBI Reference Sequence: XM_011521860.2
gaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagctaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagt

SEQ ID NO: 568 - RNA, 2109 nt, Homo sapiens
  source 1..2109: mol_type = unassigned RNA; note = Homo sapiens RAD51 recombinase (RAD51), transcript variant X6, mRNA, NCBI Reference Sequence: XM_011521861.2
cttgggagtcgtggtcttcgatctggtaaacagaagacggcaactcgtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacca

SEQ ID NO: 569 - RNA, 1636 nt, Homo sapiens
  source 1..1636: mol_type = unassigned RNA; note = Homo sapiens RAD51 recombinase (RAD51), transcript variant X7, mRNA, NCBI Reference Sequence: XM_011521862.3
agggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtt

SEQ ID NO: 570 - RNA, 2654 nt, Homo sapiens
  source 1..2654: mol_type = unassigned RNA; note = Homo sapiens enhancer of zeste 2 polycomb repressive complex 2 subunit (EZH2), transcript variant 1, mRNA, NCBI Reference Sequence: NM_004456.5
gtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtc

SEQ ID NO: 571 - RNA, 2522 nt, Homo sapiens
  source 1..2522: mol_type = unassigned RNA; note = Homo sapiens enhancer of zeste 2 polycomb repressive complex 2 subunit (EZH2), transcript variant 2, mRNA, NCBI Reference Sequence: NM_152998.3
gtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtc

SEQ ID NO: 572 - RNA, 2639 nt, Homo sapiens
  source 1..2639: mol_type = unassigned RNA; note = Homo sapiens enhancer of zeste 2 polycomb repressive complex 2 subunit (EZH2), transcript variant 3, mRNA, NCBI Reference Sequence: NM_001203247.2
gtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtc

SEQ ID NO: 573 - RNA, 2612 nt, Homo sapiens
  source 1..2612: mol_type = unassigned RNA; note = Homo sapiens enhancer of zeste 2 polycomb repressive complex 2 subunit (EZH2), transcript variant 4, mRNA, NCBI Reference Sequence: NM_001203248.2
gtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtc

SEQ ID NO: 574 - RNA, 2647 nt, Homo sapiens
  source 1..2647: mol_type = unassigned RNA; note = Homo sapiens enhancer of zeste 2 polycomb repressive complex 2 subunit (EZH2), transcript variant 5, mRNA, NCBI Reference Sequence: NM_001203249.2
ggagtagcttcgcctctgacgtttccccacgacgcaccccgaaatccccctgagctccggcggtcgcgggctgccctcgccgcctggtctggctttatgctaagtttgagggaagagtcgagctgctctgctctctattgattgtgtttctggagggcgtcctgttgaattcccacttcattgtgtacatccccttccgttccccccaaaaatctgtgccacagggttactttttgaaagcgggaggaatcgagaagcacgatcttttggaaaacttggtgaacgcctaaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaagggtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtc

SEQ ID NO: 575 - RNA, 5144 nt, Homo sapiens
  source 1..5144: mol_type = unassigned RNA; note = Homo sapiens enhancer of zeste 2 polycomb repressive complex 2 subunit (EZH2), transcript variant X3, mRNA, NCBI Reference Sequence: XM_005249962.4
gaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgtt

SEQ ID NO: 576 - RNA, 5117 nt, Homo sapiens
  source 1..5117: mol_type = unassigned RNA; note = Homo sapiens enhancer of zeste 2 polycomb repressive complex 2 subunit (EZH2), transcript variant X6, mRNA, NCBI Reference Sequence: XM_005249963.4
gaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgtt

SEQ ID NO: 577 - RNA, 4992 nt, Homo sapiens
  source 1..4992: mol_type = unassigned RNA; note = Homo sapiens enhancer of zeste 2 polycomb repressive complex 2 subunit (EZH2), transcript variant X21, mRNA, NCBI Reference Sequence: XM_005249964.4
tgaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaagggtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgtt

SEQ ID NO: 578 - RNA, 2692 nt, Homo sapiens
  source 1..2692: mol_type = unassigned RNA; note = Homo sapiens enhancer of zeste 2 polycomb repressive complex 2 subunit (EZH2), transcript variant X2, mRNA, NCBI Reference Sequence: XM_011515883.2
gggcggcccggccggcggggctccgggagtgcgaaccgggcggcggcggcggcgccaggacctccccgccactgctgtgccggtcccgggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 579 - RNA, 2824 nt, Homo sapiens
  source 1..2824: mol_type = unassigned RNA; note = Homo sapiens enhancer of zeste 2 polycomb repressive complex 2 subunit (EZH2), transcript variant X4, mRNA, NCBI Reference Sequence: XM_011515884.2
actcggagtagcttcgcctctgacgtttccccacgacgcaccccgaaatccccctgagctccggcggtcgcgggctgccctcgccgcctggtctggctttatgctaagtttgagggaagagtcgagctgctctgctctctattgattgtgtttctggagggcgtcctgttgaattcccacttcattgtgtacatccccttccgttccccccaaaaatctgtgccacagggttactttttgaaagcgggaggaatcgagaagcacgatcttttggaaaacttggtgaacgcctaaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 580 - RNA, 5133 nt, Homo sapiens
  source 1..5133: mol_type = unassigned RNA; note = Homo sapiens enhancer of zeste 2 polycomb repressive complex 2 subunit (EZH2), transcript variant X5, mRNA, NCBI Reference Sequence: XM_011515885.2
ctgaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 581 - RNA, 2841 nt, Homo sapiens
  source 1..2841: mol_type = unassigned RNA; note = Homo sapiens enhancer of zeste 2 polycomb repressive complex 2 subunit (EZH2), transcript variant X7, mRNA, NCBI Reference Sequence: XM_011515886.2
aaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgccattcacctgctcttccctctacgattttccataacacagtttttacttggaaccagccttctgccaagagtctcagtttggttgtgtactcctacaactactatttttggcttgacttccctctccagctcccagtggtccagccacacagtcgcctattgtaccagctggttgattgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 582 - RNA, 2685 nt, Homo sapiens
  source 1..2685: mol_type = unassigned RNA; note = Homo sapiens enhancer of zeste 2 polycomb repressive complex 2 subunit (EZH2), transcript variant X8, mRNA, NCBI Reference Sequence: XM_011515887.3
cgcttgattgggctgggggggccaaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 583 - RNA, 2812 nt, Homo sapiens
  source 1..2812: mol_type = unassigned RNA; note = Homo sapiens enhancer of zeste 2 polycomb repressive complex 2 subunit (EZH2), transcript variant X9, mRNA, NCBI Reference Sequence: XM_011515888.2
cgttcgcggcggggaactcggagtagcttcgcctctgacgtttccccacgacgcaccccgaaatccccctgagctccggcggtcgcgggctgccctcgccgcctggtctggctttatgctaagtttgagggaagagtcgagctgctctgctctctattgattgtgtttctggagggcgtcctgttgaattcccacttcattgtgtacatccccttccgttccccccaaaaatctgtgccacagggttactttttgaaagcgggaggaatcgagaagcacgatcttttggaaaacttggtgaacgcctaaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 584 - RNA, 2614 nt, Homo sapiens
  source 1..2614: mol_type = unassigned RNA; note = Homo sapiens enhancer of zeste 2 polycomb repressive complex 2 subunit (EZH2), transcript variant X11, mRNA, NCBI Reference Sequence: XM_011515889.2
atctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttttttacttggaaccagccttctgccaagagtctcagtttggttgtgtactcctacaactactatttttggcttgacttccctctccagctcccagtggtccagccacacagtcgcctattgtaccagctggttgattgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 585 - RNA, 5043 nt, Homo sapiens
  source 1..5043: mol_type = unassigned RNA; note = Homo sapiens enhancer of zeste 2 polycomb repressive complex 2 subunit (EZH2), transcript variant X12, mRNA, NCBI Reference Sequence: XM_011515890.2
ctgaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 586 - RNA, 2440 nt, Homo sapiens
  source 1..2440: mol_type = unassigned RNA; note = Homo sapiens enhancer of zeste 2 polycomb repressive complex 2 subunit (EZH2), transcript variant X13, mRNA, NCBI Reference Sequence: XM_011515891.3
ggccaaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 587 - RNA, 5036 nt, Homo sapiens
  source 1..5036: mol_type = unassigned RNA; note = Homo sapiens enhancer of zeste 2 polycomb repressive complex 2 subunit (EZH2), transcript variant X14, mRNA, NCBI Reference Sequence: XM_011515892.2
cctgaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaagggtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgtt

SEQ ID NO: 588 - RNA, 5027 nt, Homo sapiens
  source 1..5027: mol_type = unassigned RNA; note = Homo sapiens enhancer of zeste 2 polycomb repressive complex 2 subunit (EZH2), transcript variant X15, mRNA, NCBI Reference Sequence: XM_011515893.2
gaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgtt

SEQ ID NO: 589 - RNA, 2542 nt, Homo sapiens
  source 1..2542: mol_type = unassigned RNA; note = Homo sapiens enhancer of zeste 2 polycomb repressive complex 2 subunit (EZH2), transcript variant X17, mRNA, NCBI Reference Sequence: XM_011515894.2
gtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 590 - RNA, 5016 nt, Homo sapiens
  source 1..5016: mol_type = unassigned RNA; note = Homo sapiens enhancer of zeste 2 polycomb repressive complex 2 subunit (EZH2), transcript variant X19, mRNA, NCBI Reference Sequence: XM_011515895.2
ctgaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 591 - RNA, 4902 nt, Homo sapiens
  source 1..4902: mol_type = unassigned RNA; note = Homo sapiens enhancer of zeste 2 polycomb repressive complex 2 subunit (EZH2), transcript variant X22, mRNA, NCBI Reference Sequence: XM_011515896.2
tgaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaagggtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgtt

SEQ ID NO: 592 - RNA, 2868 nt, Homo sapiens
  source 1..2868: mol_type = unassigned RNA; note = Homo sapiens enhancer of zeste 2 polycomb repressive complex 2 subunit (EZH2), transcript variant X23, mRNA, NCBI Reference Sequence: XM_011515897.2
aaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggccattcacctgctcttccctctacgattttccataacacagtttttacttggaaccagccttctgccaagagtctcagtttggttgtgtactcctacaactactatttttggcttgacttccctctccagctcccagtggtccagccacacagtcgcctattgtaccagctggttgattgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 593 - RNA, 2795 nt, Homo sapiens
  source 1..2795: mol_type = unassigned RNA; note = Homo sapiens enhancer of zeste 2 polycomb repressive complex 2 subunit (EZH2), transcript variant X24, mRNA, NCBI Reference Sequence: XM_011515898.2
tttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtttttacttggaaccagccttctgccaagagtctcagtttggttgtgtactcctacaactactatttttggcttgacttccctctccagctcccagtggtccagccacacagtcgcctattgtaccagctggttgattgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 594 - RNA, 4547 nt, Homo sapiens
  source 1..4547: mol_type = unassigned RNA; note = Homo sapiens enhancer of zeste 2 polycomb repressive complex 2 subunit (EZH2), transcript variant X26, mRNA, NCBI Reference Sequence: XM_011515899.3
catcctgaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggctttaggagatgcttctgaaattttggttgaattatttctgaccacgtagttcacttgcttggtttatgatgcctgaaataagaggaagtgatcagtgtcatccacatcagaataaatcaacaggcagacacacctgctgctttgtgcagcattgggagctcaggagttctgaccaggagtcatggatgaacacaggaaatgacgtcttgccacacctggggcagcctgagccatcaagctgtttgagttgcttcaaactgatggcaaatataaactgggcagggcatgactcttggctttaacgcattcctgtattcatggcacagatagatccagttaagcagctctctgttggatttgtagcttcccgcagaaatttggtttaattttctttgtgttt

SEQ ID NO: 595 - RNA, 3997 nt, Homo sapiens
  source 1..3997: mol_type = unassigned RNA; note = Homo sapiens enhancer of zeste 2 polycomb repressive complex 2 subunit (EZH2), transcript variant X30, mRNA, NCBI Reference Sequence: XM_011515901.3
catcctgaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctggttgtgggctgcacactgcagaaagatacagctgaaaaagggtcaaaaccgctttccgggatgccgctgcaaagcacagtgcaacaccaagcagtgcccgtgctacctggctgtccg

SEQ ID NO: 596 - RNA, 5160 nt, Homo sapiens
  source 1..5160: mol_type = unassigned RNA; note = Homo sapiens enhancer of zeste 2 polycomb repressive complex 2 subunit (EZH2), transcript variant X1, mRNA, NCBI Reference Sequence: XM_017011817.2
ctgaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 597 - RNA, 2827 nt, Homo sapiens
  source 1..2827: mol_type = unassigned RNA; note = Homo sapiens enhancer of zeste 2 polycomb repressive complex 2 subunit (EZH2), transcript variant X10, mRNA, NCBI Reference Sequence: XM_017011818.1
aaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgccattcacctgctcttccctctacgattttccataacacagtttttacttggaaccagccttctgccaagagtctcagtttggttgtgtactcctacaactactatttttggcttgacttccctctccagctcccagtggtccagccacacagtcgcctattgtaccagctggttgattgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgtt

SEQ ID NO: 598 - RNA, 5019 nt, Homo sapiens
  source 1..5019: mol_type = unassigned RNA; note = Homo sapiens enhancer of zeste 2 polycomb repressive complex 2 subunit (EZH2), transcript variant X18, mRNA, NCBI Reference Sequence: XM_017011819.1
tgaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaagggtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgtt

SEQ ID NO: 599 - RNA, 2568 nt, Homo sapiens
  source 1..2568: mol_type = unassigned RNA; note = Homo sapiens enhancer of zeste 2 polycomb repressive complex 2 subunit (EZH2), transcript variant X20, mRNA, NCBI Reference Sequence: XM_017011820.2
cgcttgattgggctgggggggccaaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgt

SEQ ID NO: 600 - RNA, 2854 nt, Homo sapiens
  source 1..2854: mol_type = unassigned RNA; note = Homo sapiens enhancer of zeste 2 polycomb repressive complex 2 subunit (EZH2), transcript variant X25, mRNA, NCBI Reference Sequence: XM_017011821.1
aaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggccattcacctgctcttccctctacgattttccataacacagtttttacttggaaccagccttctgccaagagtctcagtttggttgtgtactcctacaactactatttttggcttgacttccctctccagctcccagtggtccagccacacagtcgcctattgtaccagctggttgattgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgtt

SEQ ID NO: 601 - RNA, 2426 nt, Homo sapiens
  source 1..2426: mol_type = unassigned RNA; note = Homo sapiens enhancer of zeste 2 polycomb repressive complex 2 subunit (EZH2), transcript variant X16, mRNA, NCBI Reference Sequence: XM_024446680.1
ggccaaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgtt

SEQ ID NO: 602 - RNA, 4893 nt, Homo sapiens
  source 1..4893: mol_type = unassigned RNA; note = omo sapiens enhancer of zeste 2 polycomb repressive complex 2 subunit (EZH2), transcript variant X29, misc_RNA, NCBI Reference Sequence: XR_001744581.1
atcctgaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtc

SEQ ID NO: 603 - RNA, 5558 nt, Homo sapiens
  source 1..5558: mol_type = unassigned RNA; note = Homo sapiens enhancer of zeste 2 polycomb repressive complex 2 subunit (EZH2), transcript variant X27, misc_RNA, NCBI Reference Sequence: XR_002956413.1
cctgaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggctttaggagatgcttctgaaattttggttgaattatttctgaccacgtagttcacttgcttggtttatgatgcctgaaataagaggaagtgatcagtgtcatccacatcagaataaatcaacaggcagacacacctgctgctttgtgcagcattgggagctcaggagttctgaccaggagtcatggatgaacacaggaaatgacgtcttgccacacctggggcagcctgagccatcaagctgtttgagttgcttcaaactgatggcaaatataaactgggcagggcatgactcttggctttaacgcattcctgtattcatggcacagatagatccagttaagcagctctctgttggatttgtagcttcccgcagaaatttggtttaattttctttgtgtttttgcaggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaa

SEQ ID NO: 604 - RNA, 6018 nt, Homo sapiens
  source 1..6018: mol_type = unassigned RNA; note = Homo sapiens enhancer of zeste 2 polycomb repressive complex 2 subunit (EZH2), transcript variant X28, misc_RNA, NCBI Reference Sequence: XR_002956414.1
atcctgaaaccatgtaccctctcccctctttgtggaaaaactgtcttccacaaaaccagtccctggtgcaaaaaagttggagactgctggtttaaagtatatgggagaatgtgtatacgttatgtaatagtgtaccattttatatcagggacttgagtcttcgtggattttggtatctgttgggggtcctggaactaatcctccgtggatatggaggaacaactgtatatatggtctcagtaataaatacgtatctgagataccctctgtattaagaaaaaaaagatgggaatttcttggctcatataactgaatagttccgaaatttgggaaggtctgcctgacttagggcttaggtcatgagactacagttctttcttggctttgacttttgttttttgtagttgttgactctgttctttgaggctcttctccaagatggcttccaacaagtccttgggcaaacatttttccaggtttagacctaaggggagaagagtgagcattcttgtcctagcattgcaggaaacctgagattttcactgtgactgcactgattgtggccgtgtatctaaccctgtactggtcactatgtctagggagatgtaccttggtcaggccagggtcacaagcagcttgagtcagcttcctccagtgtacttggtagttctcagagaagagttggtgtgaagttcccaagagaagggtgaattgaccctgggtggcaaaaacaacatagcatctactctagtgggataaagtaagatggtaaggcatggtgttcagggtatttctgagtttggtttgattcacaaaatagattgtgaacactgtaattgcccttaattttagttaacctatgtaaatgtaaatctgtgaggtgtcactacattctgctaaagctttgatgggctcctgccatattctggtttggcttttgtattaaagagccattgttgttttggtttcactgtatacaggtagacttttgttttaatgaatagaggtataatctgttttgaacaggaaaagctgcttttgtattctggataaagttcatactagtgggatttcacctatgaaactaaacaaatctttgaaaaatttaaaaaccatatgtatttacacagtgtccattcagtagaagtcgtttaaataaaggcttctgccaatatatgaatatttagagctgtattttattattttactttttttgagacagggtctcgctctgtcacctaggctggagtgcagtggtgtgaagacagttcactgcagtctccacctcacaggctcaagagatcctcccacctcagcttcctgagtagttgggaccacaggtgtgcgccactacacctggcttgcttgcttgcttatttattgatttgagatgggagtctcactatattgcctaggctggtcttgaactcctgggctcaatcctccaaccttggcctcccaaaatgctgggtttacaggcttgaaccactgtacgtggccttgaatctgtgttttaatactatgcttacttggctgtggtgttgtgaaaagatcactgaaaatggagtcagaggcctgatttgagccagtcgtttgttgtgggggaaggaggtcaggggagctaacatctaaaggctcactatatgccaggcacagaaccaagtgtgtttgcatgtatatttcgtttttgttgccagactttgaggtaggttttatggataaggtctttaaggcaatatcagcttccttttaaaaaagaaattccggaaactgagttttaggctgaagatctctaactggtagtagggacaactgaaccacagggtcctaactgaccctgcgatttatctccttttgcggggggtttcttgataatagggtgcactttacctcattttttggctcaagcatggataggccacccttccttttcatacctatagctaagctttacaaatgatatgctgataagatacaagctactcgttattcatgtgggttaatagacctgtttgtttgcttgtttttaagtctatagccgccccacccccaatctacaatttcaccttctaaggttttagttactcattcaaactgcagtctgaaaatgttacgatattttgagagagagaagactctagctacgtaacttttgtaacaatatattgttataattgttcattttaccattagttattgctgtcagtctcttactgtgccttatttataaattaaacttcatgggtatgtacgtataggaaaaaacatggtatatttagagtttagtactatctgcagctttaggcatccgctgtggggttggcggggggcggtcttgggagataagtggggactactgtacaattatcaggcacacacaggctctgggattttacaaatgagtaaaagtggttcttgctgttgaagcacttacagtgggaatagagtgaaatacatgaaaatgtgattttaatatgttataaatgctatgatggtgggagtttgttttgtgtaaaacatccttttaattggtactttaaattttaatattctttcacaggtctacctatttagtcttacactttcaaagaactacctggatgctgtagattttcatgatatactttattagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtaagatatccgataaaaatgttgttaaaagagcttcaaacatagagataaaactgtactcgttgtccaaacaaagaaaattcttggttattactaagctcctattcatctcctaaaaataatttttttttcttcccaagagggaattgaatgaaaattattctccaggtatgttacagaatttccccaatgtagacttttaaggttagatagcagtagcttttaaaagctagtaagaattgaaatttagcatcacagttcttgaccagaatataattacagctacccctaatgtgagggtagggacagcgatgtgtgttatatccccagcatctagcagtgtcacagaagagacaaagacatttttctggtatgcatgagtataagaatggtttgcctaaataagactgtcctcatggctctgtgactgtgcctcttgtcaggtgtatgagtttagagtcaaagaatctagcatcatagctccagctcccgctgaggatgtggatactcctccaaggaaaaagaagaggaaacaccggctttaggagatgcttctgaaattttggttgaattatttctgaccacgtagttcacttgcttggtttatgatgcctgaaataagaggaagtgatcagtgtcatccacatcagaataaatcaacaggcagacacacctgctgctttgtgcagcattgggagctcaggagttctgaccaggagtcatggatgaacacaggaaatgacgtcttgccacacctggggcagcctgagccatcaagctgtttgagttgcttcaaactgatggcaaatataaactgggcagggcatgactcttggctttaacgcattcctgtattcatggcacagatagatccagttaagcagctctctgttggatttgtagcttcccgcagaaatttggtttaattttctttgtgtttttgcaggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaa

SEQ ID NO: 605 - RNA, 2512 nt, Homo sapiens
  source 1..2512: mol_type = unassigned RNA; note = Homo sapiens tumor protein p53 (TP53), transcript variant 1, mRNA, NCBI Reference Sequence: NM_000546.6
ctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 606 - RNA, 2509 nt, Homo sapiens
  source 1..2509: mol_type = unassigned RNA; note = Homo sapiens tumor protein p53 (TP53), transcript variant 2, mRNA, NCBI Reference Sequence: NM_001126112.3
ctcaaaagtctagagccaccgtccagggagcaggtagctgctgggctccggggacactttgcgttcgggctgggagcgtgctttccacgacggtgacacgcttccctggattggccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 607 - RNA, 2572 nt, Homo sapiens
  source 1..2572: mol_type = unassigned RNA; note = Homo sapiens tumor protein p53 (TP53), transcript variant 4, mRNA, NCBI Reference Sequence: NM_001126113.3
ctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 608 - RNA, 2645 nt, Homo sapiens
  source 1..2645: mol_type = unassigned RNA; note = Homo sapiens tumor protein p53 (TP53), transcript variant 3, mRNA, NCBI Reference Sequence: NM_001126114.3
ctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 609 - RNA, 2003 nt, Homo sapiens
  source 1..2003: mol_type = unassigned RNA; note = Homo sapiens tumor protein p53 (TP53), transcript variant 5, mRNA, NCBI Reference Sequence: NM_001126115.2
tcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 610 - RNA, 2136 nt, Homo sapiens
  source 1..2136: mol_type = unassigned RNA; note = Homo sapiens tumor protein p53 (TP53), transcript variant 6, mRNA, NCBI Reference Sequence: NM_001126116.2
tcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 611 - RNA, 2063 nt, Homo sapiens
  source 1..2063: mol_type = unassigned RNA; note = Homo sapiens tumor protein p53 (TP53), transcript variant 7, mRNA, NCBI Reference Sequence: NM_001126117.2
tcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 612 - RNA, 2629 nt, Homo sapiens
  source 1..2629: mol_type = unassigned RNA; note = Homo sapiens tumor protein p53 (TP53), transcript variant 8, mRNA, NCBI Reference Sequence: NM_001126118.2
ctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactgtgagtggatccattggaagggcaggcccaccacccccaccccaaccccagccccctagcagagacctgtgggaagcgaaaattccatgggactgactttctgctcttgtctttcagacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 613 - RNA, 2572 nt, Homo sapiens; identical to SEQ ID NO: 607
  source 1..2572: mol_type = unassigned RNA; note = Homo sapiens tumor protein p53 (TP53), transcript variant 4, mRNA, NCBI Reference Sequence: NM_001276695.3

SEQ ID NO: 614 - RNA, 2645 nt, Homo sapiens; identical to SEQ ID NO: 608
  source 1..2645: mol_type = unassigned RNA; note = Homo sapiens tumor protein p53 (TP53), transcript variant 3, mRNA, NCBI Reference Sequence: NM_001276696.3

SEQ ID NO: 615 - RNA, 2003 nt, Homo sapiens; identical to SEQ ID NO: 609
  source 1..2003: mol_type = unassigned RNA; note = Homo sapiens tumor protein p53 (TP53), transcript variant 5, mRNA, NCBI Reference Sequence: NM_001276697.3

SEQ ID NO: 616 - RNA, 2136 nt, Homo sapiens; identical to SEQ ID NO: 610
  source 1..2136: mol_type = unassigned RNA; note = Homo sapiens tumor protein p53 (TP53), transcript variant 6, mRNA, NCBI Reference Sequence: NM_001276698.3

SEQ ID NO: 617 - RNA, 2063 nt, Homo sapiens; identical to SEQ ID NO: 611
  source 1..2063: mol_type = unassigned RNA; note = Homo sapiens tumor protein p53 (TP53), transcript variant 7, mRNA, NCBI Reference Sequence: NM_001276699.3

SEQ ID NO: 618 - RNA, 2512 nt, Homo sapiens; identical to SEQ ID NO: 605
  source 1..2512: mol_type = unassigned RNA; note = Homo sapiens tumor protein p53 (TP53), transcript variant 1, mRNA, NCBI Reference Sequence: NM_001276760.3

SEQ ID NO: 619 - RNA, 2509 nt, Homo sapiens; identical to SEQ ID NO: 606
  source 1..2509: mol_type = unassigned RNA; note = Homo sapiens tumor protein p53 (TP53), transcript variant 2, mRNA, NCBI Reference Sequence: NM_001276761.3

SEQ ID NO: 620 - RNA, 2029 nt, Homo sapiens
  source 1..2029: mol_type = unassigned RNA; note = Homo sapiens cyclin B1 (CCNB1), transcript variant 1, mRNA, NCBI Reference Sequence: NM_031966.4
ggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaa

SEQ ID NO: 621 - RNA, 1918 nt, Homo sapiens
  source 1..1918: mol_type = unassigned RNA; note = Homo sapiens cyclin B1 (CCNB1), transcript variant 2, mRNA, NCBI Reference Sequence: NM_001354844.2
ggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaa

SEQ ID NO: 622 - RNA, 1870 nt, Homo sapiens
  source 1..1870: mol_type = unassigned RNA; note = Homo sapiens cyclin B1 (CCNB1), transcript variant 3, mRNA, NCBI Reference Sequence: NM_001354845.2
ggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaa

SEQ ID NO: 623 - RNA, 5227 nt, Homo sapiens
  source 1..5227: mol_type = unassigned RNA; note = Homo sapiens mitotic arrest deficient 2 like 1 (MAD2L1), mRNA, NCBI Reference Sequence: NM_002358.4
ctgacgacgtgctgcgtcgttacttttgaaacgcttggcggggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaagtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaatttgtcttaaaacattttgatactggtttggtgttgatatagttaaatggtaattagaattgattcagcatagctaatgaattcttgttcctacgaagttatagaacttaagggtccaaagttgagtgagtcttgaggtgtcttcaatctaatggataaactttgatcacatcctgttcatctcatagcaatagacttaaggctattacttcatcattgtgaaaagataaatgtcctttggaattagtccaacaattccagttgaacaagtgttgattttagtactttactatactcttagccttattgtcagcctacttttccttatatacttaaatactatgcttattcctgtgctttcattaataccctcatctggtacatgctttctatccagttctcacctgtttttccaaggtcagtttaaggcagatttgtaaagtcttctctaatctctaatctaaatctgacctcattttgtaaaaattcagtttattaatgtttattattagacactaagttctttatgtgtattaacttatttaaccttcactatttttaagtaattgcacatagtctgaatctgttcattcagaaattacatattgagcaaatactgtggatcagtggcagtttctgggttctcagtgacaaatttgtagactcttcatatctttatggaataagtggaccactggtgttaccaacctagatgatttcaagaaaagtggcaattaaatgcttcatttgtattttaactatttgagaagtcagactaaattctgcgaaatcacttttcccccccaagatggagtcttattctgtcgcccaggctggagtacagtgacgcagctcagctcactacagcctctgcctcccggattccagccattcttccgtctcagcctcctgagtagctgggattacaggcacgtgccaccacacctggctaatttttatatttttagtagagagagggtttcaccatgttggccaggctagtcttgaactcctgacctcatgatctgcccgccttgacctcacaaagcattgggattacaggcgtgagccactgcgcccggctgaaatcacatttttaaaggttgtgtgtatactctggtcatttcaactcagctaccaatattaacaggattaaattcttagatttttgtatcatttgcatgctactatttactctgaggtttctggagagctagtcatgatgagtcattttaccccttacagattatataatcaattaagaaatacacattttgggctgggcgcagtggctcgcgcctgtaatcccagcactttgggaggccgaggcaggtggatcacgagatcaggagtttgagaccagcctggccaagatggtcaaaccccgtctctactaaaaatataaaaattagctgggcgtggtggcgggcgcatctcagctacttgggaggctgaggcaggagaaatcgcttgaacccatgaggtggaggttgcggtgagccaagaccgtgccactgtactctagcctgggcgacagagcaaggctccatctcaaaaaataataaataaaaaagaaatacacattttggagctgagtgggagccaaactatgagttttattgaggtgaagctatactggaaaagctttgccctgtagctccaagtggactgtcccatcctctttctagaccttgaggcttacctcaggaggatgatgtttaaatcaacagctgaaagacttgtgagtggtttctacaccatgttaaagagaaggttctaagacagcatgataggcctctaggcctggcctggactctggctcagtgttgcttaccatatgtagaggatgaacagaggttaagcccatcaaggtctgaagtagagcccaggaggaactgaactgtatctggctttcaggatccttttcccagtgtcatcaatcagagaagtcaaacctctgtgagaatgcttgtgcagaggtataacagtctcatgtattggttggcttttgctgcacctttctcattctgttggagggacattggttagtcaggactctgaaggccagctttttcacactgaccaaagcaagtgaaggtcaagcctaactttaatgggaccaggaagtatactcctcccatggaggtggtgggaatggcaccgagaagtttgatgacagttatctaatggactagaggttggcaaactttctgtaaatggccaggtagtaaatagttctgcttttgaaggcatatggtctcttgcacctactcgaggctgaaagcagctatagacaatacataaatgaatgagcgtgagtgtgttccaataagaaaaaaacatggctgtttgcttcggccccagggttgtagcttaccagtcctgtaacagatcacagtttgctcttttggtcacaaatacttgaacccctccctagttcagagcatttgataccgtaatatttaaagctcacttgtaaaacatcgtttgttgcctccatccatagtatctcaaacagaatgtctctcccaaatatacctaaattccatattctctgaagcacaaccagctattttcttgacatacttcctaacacaccccacagttcacaatttgatctgaaaacttgttaagggaggttctttggcatgtgatgccataaaaagagaggtatgggctctcctttaaaaaagagaccctttttatgagactcacaataggataaagagcccatgcctatttttaatcattttttcactatatagacatgcatgctgaaaaatgtttttattagtataatgctaattatactgacttcctatatattttagcatatagattcaaagattattagcacaataaggtagataacttcatagaccatttcttcatcttgttttcatttagtatgtaaaatttatctaaaatttacatgaaagatcagaatagctatgtaatgctactttgtaactcttatattttccaccagatgtcactaatgctgtaatattcaaattaagatgactttcttttggttctaaaggctgtaagcttattggaaaagcaaggttactcagcattggaattcctggcaacaaatatataaatacattaggggaataaacacttagcatttattatttactagtcacttcacatgaatttttatttaattctcatgcttttgtgcacaagtaaaactgggggtcaatgggcatgcaaattgtgtcgtggtttttgaagtttagtggtctctcctatccctggccaaggaagtatgcaaattgtattgtggtttttgaagtttaggtgatctcttccttctatccctagccaaggaagttcatcctgactccccaacaagcatatcaaaaggagtgtttcgtcacctttttcctcttaccctttacatccttttagcaataaagtgttcagaacaaactggttttcctttactgtgctttgcaaaacttattcatgttttattgggtgactttgtatttacactttcctcagatagtctgttgtcagatgactttgaccaatgattgggaggaaccaaatacagaggattttatcctatgcctaatctatattgtctacagagtaaatcaggtatgaatttgtgaacagtaatgaaacaattttccaactaatcagaagaattgtttgttaagtaaccttaattactcagtttttggtgaattgtttgcggcttaacttgtaaataatttcttattctttttttaaatgtatgaaatatttctagttattttgttcaatgtgactgataaaagtttatattggaata

SEQ ID NO: 624 - RNA, 2957 nt, Homo sapiens
  source 1..2957: mol_type = unassigned RNA; note = Homo sapiens AKT serine/threonine kinase 1 (AKT1), transcript variant 4, mRNA, NCBI Reference Sequence: NM_001382430.1
ggcggcggcaggaccgagcgcggcaggcggctggcccagcgcacgcagcgcggcccgaagacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccgtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 625 - RNA, 3008 nt, Homo sapiens
  source 1..3008: mol_type = unassigned RNA; note = Homo sapiens AKT serine/threonine kinase 1 (AKT1), transcript variant 1, mRNA, NCBI Reference Sequence: NM_005163.2
taattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaaaaaaaaaaaaaaaaaaaaa

SEQ ID NO: 626 - RNA, 2779 nt, Homo sapiens
  source 1..2779: mol_type = unassigned RNA; note = Homo sapiens AKT serine/threonine kinase 1 (AKT1), transcript variant 3, mRNA, NCBI Reference Sequence: NM_001014431.2
ggcggcggcaggaccgagcgcggcaggcggctggcccagcgcacgcagcgcggcccgaagacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccgaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 627 - RNA, 2863 nt, Homo sapiens
  source 1..2863: mol_type = unassigned RNA; note = Homo sapiens AKT serine/threonine kinase 1 (AKT1), transcript variant 2, mRNA, NCBI Reference Sequence: NM_001014432.2
ggcggcggcaggaccgagcgcggcaggcggctggcccagcgcacgcagcgcggcccgaagacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 628 - RNA, 2922 nt, Homo sapiens
  source 1..2922: mol_type = unassigned RNA; note = Homo sapiens AKT serine/threonine kinase 1 (AKT1), transcript variant 5, mRNA, NCBI Reference Sequence: NM_001382431.1
ggcggcggcaggaccgagcgcggcaggcggctggcccagcgcacgcagcgcggcccgaagacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccggccacgcccactcagtgtcgtcagagccccctgtgcctgaggcgtgcgcggctcggagccctgccctcggagtcctgcggtgccttcctcgagtctggcctgctttccatcctgctaagtacttggggcatttccctctttggaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 629 - RNA, 3006 nt, Homo sapiens
  source 1..3006: mol_type = unassigned RNA; note = Homo sapiens AKT serine/threonine kinase 1 (AKT1), transcript variant 6, mRNA, NCBI Reference Sequence: NM_001382432.1
ggcggcggcaggaccgagcgcggcaggcggctggcccagcgcacgcagcgcggcccgaagacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccggccacgcccactcagtgtcgtcagagccccctgtgcctgaggcgtgcgcggctcggagccctgccctcggagtcctgcggtgccttcctcgagtctggcctgctttccatcctgctaagtacttggggcatttccctctttgggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 630 - RNA, 3075 nt, Homo sapiens
  source 1..3075: mol_type = unassigned RNA; note = Homo sapiens AKT serine/threonine kinase 1 (AKT1), transcript variant 7, mRNA, NCBI Reference Sequence: NM_001382433.1
ggcggcggcaggaccgagcgcggcaggcggctggcccagcgcacgcagcgcggcccgaagacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccggccacgcccactcagtgtcgtcagagccccctgtgcctgaggcgtgcgcggctcggagccctgccctcggagtcctgcggtgccttcctcgagtctggcctgctttccatcctgctaatctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 631 - RNA, 4152 nt, Homo sapiens
  source 1..4152: mol_type = unassigned RNA; note = Homo sapiens AKT serine/threonine kinase 1 (AKT1), transcript variant X1, misc_RNA, NCBI Reference Sequence: XR_002957536.1
ggctaggcccgcgctcgcgcccggacgcggcggcccggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaaggtgcggctgctccccgcatattcacgcgcacgcatgctccccacatatccacactcacgcatgcacgtggcacgctcgccagatttcccacacactcgccctcacctcaggagcctgctgcagtcctggtacaaggagggccttgctgcaccaacctcagcgcctggtgctcagaggctctggcactgccgggttccaccaggaaactggcctggtcctcatttcctcctcccctcggaggtgtgtcacactctgagtttcctcctcccctcggaggtgtgtcacactctgagtgccagccttggggttcccttccctgacgctgtgcagtgaaggctggctggtggtggaccaggggtgctgccccttggcctccacgagttcctcctgtttgacctcaatcccttctgccgcaaggagagcccagccctatttctggctgtgcagggacagggacagcacctacttttctggcacatgggggagtccgccctggagggaggcagctctttctgcatgagtcgccatcctgggtgctcatctttcagggaccctaggagccctggccatcaccccagctgatggggtctgccagctgggttcggaagcctgcactctgagatgctgggtgccctgtcaccaggtgtgcttctgccccgttcccagcctgcccctcccctgaatgcctgtcctaggctgtgtgcagctggtcgggctgggcagccctgggacccagctgggcacctgttctcccattaacacagggtgccctggtcctggtccccgttcctgccttgaggcctgccaccctcctgccctgccctccaagggtatggggggcctgggcagtgctcaacctctgcccagccttgaccagagaccttgctaattgacaatggacaatgctggtgcccagcccagactctggggtggggcagtgcttgagggggtccttgactgtgggacctgaggggctctctggcagctcctcacgtgtgcacatcaccttatagtcacccttcatcctgggtcattgagagtcctgtctgcagccagatgccagcaggctgtggtcctgtagtccctgagccatggaggcagggtgggctcatcctgtgcaccttgttccacagtctccctctttcccaatttacaagaagaccaataagaaaaataagaaaacaagaaagaaaaaggaaaaataaagttatcacctcctggtagcagggagggtctctcagagctgggctgcactacctcctgtcgcctgctggggctgctgtgagggcagctttgcgtctcagctgttgagggttgtctccgtgctcctgcacccctcatgtccctccctcccagagctgcctctgtggggggctggtggcttgctgctctctgacatcagtcctgcctggagaccccttggagatccaggtgctttgaaggtcttgagcacacttgagggtgtgctgggagtggggagcgaagctcatgactgtcccgtctgcccacctctgcagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 632 - RNA, 5250 nt, Homo sapiens
  source 1..5250: mol_type = unassigned RNA; note = Homo sapiens AKT serine/threonine kinase 2 (AKT2), transcript variant 1, mRNA, NCBI Reference Sequence: NM_001626.6
gccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgta

SEQ ID NO: 633 - RNA, 5213 nt, Homo sapiens
  source 1..5213: mol_type = unassigned RNA; note = Homo sapiens AKT serine/threonine kinase 2 (AKT2), transcript variant 2, mRNA, NCBI Reference Sequence: NM_001243027.3
gccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgta

SEQ ID NO: 634 - RNA, 5120 nt, Homo sapiens
  source 1..5120: mol_type = unassigned RNA; note = Homo sapiens AKT serine/threonine kinase 2 (AKT2), transcript variant 3, mRNA, NCBI Reference Sequence: NM_001243028.3
gccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacaggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgta

SEQ ID NO: 635 - RNA, 4956 nt, Homo sapiens
  source 1..4956: mol_type = unassigned RNA; note = Homo sapiens AKT serine/threonine kinase 2 (AKT2), transcript variant 4, mRNA, NCBI Reference Sequence: NM_001330511.1
actgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgta

SEQ ID NO: 636 - RNA, 4320 nt, Homo sapiens
  source 1..4320: mol_type = unassigned RNA; note = Homo sapiens AKT serine/threonine kinase 2 (AKT2), transcript variant X1, mRNA, NCBI Reference Sequence: XM_011526614.1
cagatgttgtttctaaggactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaa

SEQ ID NO: 637 - RNA, 4397 nt, Homo sapiens
  source 1..4397: mol_type = unassigned RNA; note = Homo sapiens AKT serine/threonine kinase 2 (AKT2), transcript variant X2, mRNA, NCBI Reference Sequence: XM_011526615.1
gactccttagttgctgagatgagcttgtaaaaagcagctctgttgatcccagcagcggccagggcctccgctgcttctcggctgggagacccgagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaa

SEQ ID NO: 638 - RNA, 4640 nt, Homo sapiens
  source 1..4640: mol_type = unassigned RNA; note = Homo sapiens AKT serine/threonine kinase 2 (AKT2), transcript variant X3, mRNA, NCBI Reference Sequence: XM_011526616.1
gatgcccatggtgtccctagagccagctgccacttctctgggcgccaccgtagctcccgacctgctgtccgcaaataaccccaggctgggaaaggcaaaggcgccttggtctctgtggaccctggccaggccccaggctccaggtaggggcccagctggcgctgcctcgcgccctcctcccctccgttctgggaacctgagacgaagcagtggcctcggcgtccctcagtctgttggttgctggtccctgaggacagaagtgaaggtcttggggtagggatcagggcctcggtcaagcccccaggactggcttctaggccccagaccgtgcatacgcaactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaa

SEQ ID NO: 639 - RNA, 4482 nt, Homo sapiens
  source 1..4482: mol_type = unassigned RNA; note = Homo sapiens AKT serine/threonine kinase 2 (AKT2), transcript variant X6, mRNA, NCBI Reference Sequence: XM_011526618.1
tgcgggacggggagcgcaggccgcagcgtgcgcgggccgggggctggacctttcgggcgcggcgggcagatcgagcctggcgtgcgcgggctaagctatcgagggggcgcgccgcatcaagtgtagagggctgtacctttttggcgctgtggaagccgttgctgtgctgtatttacagggactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaa

SEQ ID NO: 640 - RNA, 4451 nt, Homo sapiens
  source 1..4451: mol_type = unassigned RNA; note = Homo sapiens AKT serine/threonine kinase 2 (AKT2), transcript variant X7, mRNA, NCBI Reference Sequence: XM_011526619.1
aaagctgatgcccatggtgtccctagagccagctgccacttctctgggcgccaccgtagctcccgacctgctgtccgcaaataaccccaggctgggaaaggcaaaggcgccttggtctctgtggaccctggccaggccccaggctccagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaa

SEQ ID NO: 641 - RNA, 4386 nt, Homo sapiens
  source 1..4386: mol_type = unassigned RNA; note = Homo sapiens AKT serine/threonine kinase 2 (AKT2), transcript variant X8, mRNA, NCBI Reference Sequence: XM_011526620.1
gcgcaggcgccctgctgtgagcccgcctccttctctgccctgctcttgcgctctcgctctctcagagttcgtctctggctctttactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaa

SEQ ID NO: 642 - RNA, 1496 nt, Homo sapiens
  source 1..1496: mol_type = unassigned RNA; note = Homo sapiens AKT serine/threonine kinase 2 (AKT2), transcript variant X10, mRNA, NCBI Reference Sequence: XM_011526622.2
gtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagagtggtttgtggtcaagacagaatcattaagggccatacagggcctgcctgctccgaaagcccgtctgcccgaaccc

SEQ ID NO: 643 - RNA, 6537 nt, Homo sapiens
  source 1..6537: mol_type = unassigned RNA; note = Homo sapiens AKT serine/threonine kinase 2 (AKT2), transcript variant X5, mRNA, NCBI Reference Sequence: XM_017026470.2
ccacggcgttgggggagccctgcttagaacgtaggggaacccaaatcagaggactgtgatgtttgtgatctttaagggactgggacggggcgggacaggccctagtgggttttaggggcgtattttgggaggactgtgatgccgattggtgaggaggggtttctgtttcctgtatttgacgtgtgtggcgttgggggtttacactgatctcagcctttattgaacttcttaacgactctggagggaacgtcatggttactggggtgctttggaccatggaggtgctgctctggattccattaccctctcagattatttaccaggcagtaacagttctttccttccataggggagggaggaaagctgtgttagaagtcactgaagttgtctgagccttaacattctgaagaggaagagggattgggcttggatttgaggagccgtgcccctgcacccgcttgttaaaacttgggaggaaggagtgtttgggggaacacctcttccccccagggaagctctctgggggcatcttgatcttgggattgtgaggacctcttcctctcatttggagacctcttggggctcagcaagacgcctgggctggagtaactagagcctccaatgggctgcttttcaacttcatccactcctaccttcccagagaagcagcaggagttcactcgtgggctgaacttggttggcagtggatgtgaagggtccaggaaccaacgcagaccactacatgctcctctgtcgctggccacgaagctgtttgtgtctcccagttaccagctcggtcacacatcatgtttacactccccaccaaggcagtaacagttggccttgcagtgaggccgggagctgttttcccagctgttcctctttgcataggccaaggggacttggagtgggggtgcccctggcccagcctggcccagggaggaaggctgctctgaagggcttgggacagtcagatcccccatggatctggtgtcttattgtggtctgtgggctggtgctgggagcagccagccccagaggtctgtggccagtgtccctgctccctaggccagatcatgaccttggcttgccctgtagcctttgctctgggtctggagttcccagaggactggctgcagtccctgattgacccagcagacctgggctggtgatgtggtcagagggggcagatggttgcccctagtccgcagcagtgacttccaagctgactggcttccgtggctcgtggttcctggagagaaaggtcccacagtctgtgaggcagcggcgactctgtagaatctttctccactaggggtttgttcctctggtcctctcctgccagcttttagagggtttgcctgatggggctaacagtggcagtgaaaacagtaatcatgaaattgatggctgacagtaactgagtgcattctgtgggccacacactgtttggaatgcttcatatagataaacttgctgaatacttgaattctagagcggtaggcgctgttgttatgctctcccttttagatgagaaaacagcatctcagagaggcagatcatttccagagctagtggatgcccagtgtttatagcattcaccccatgccaggcgtgtgacagggcttttgtacatgtgatctcacttaagtctcaaaacatacctgtggttaggcctattttatggagagctacgagctagttagaagtgtgataccattttacagatgaggaatcatttcactcactgtgaagtgcaaagatttcccagaggtctcatagctgaagtgggagaggtgtgatgtgagcccttggccaaccttggcctcagatcgtcttgtcaaggagaaactggaggagtggcttttgtctgtgagcatatactctgcccagccctgtgctttgggctttatatggtatttgtgtccttttttgcagagtccgaaattgaagttcagaggaagaattgccttccaccgcatcttatcagaccctatgggtgccagggtgtgtgctgggagaagaagacagcaagagagccatgcagggggtgacacagctaccagggacctgcgttagctagcagcaggacggtgaagtcggttctagctctgcgaccttggaccacactgttcactcccatacagtggtctcagaaggacgtccaccttgggctgttgtgaggattaaatgaattaatccacgagaagctcctagaatggtgcctggtactgtactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaa

SEQ ID NO: 644 - RNA, 4752 nt, Homo sapiens
  source 1..4752: mol_type = unassigned RNA; note = Homo sapiens AKT serine/threonine kinase 2 (AKT2), transcript variant X4, mRNA, NCBI Reference Sequence: XM_024451416.1
attccttgctcaccaggttccaggctgggtgaaaggaaggaaagacataggatagagtcacctctgtcctctgtcctctacctatagaggtgactgtcctatgtctttccttcctcttacccctgagcctcaggctgccctgagcatctctgcctacagccagtccagcatttcttggtccctcctcagagtggaggcaaggcatcctttaaccctgggcaggtgtgtgctgggagaagaagacagcaagagagccatgcagggggtgacacagctaccagggacctgcgttagctagcagcaggacggtgaagtcggttctagctctgcgaccttggaccacactgttcactcccatacagtggtctcagaaggacgtccaccttgggctgttgtgaggattaaatgaattaatccacgagaagctcctagaatggtgcctggtactgtactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaa

SEQ ID NO: 645 - RNA, 4335 nt, Homo sapiens
  source 1..4335: mol_type = unassigned RNA; note = Homo sapiens AKT serine/threonine kinase 2 (AKT2), transcript variant X9, mRNA, NCBI Reference Sequence: XM_024451417.1
gtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcgtcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaa

SEQ ID NO: 646 - RNA, 7281 nt, Homo sapiens
  source 1..7281: mol_type = unassigned RNA; note = Homo sapiens AKT serine/threonine kinase 3 (AKT3), transcript variant 1, mRNA, NCBI Reference Sequence: NM_005465.7
gcagcccttcgcttgccctcccgccggccgcaccgggctccaggaggccagaggctctgtggggtggggggaggacaggaggggaggaggagggaggggggacccccgagtcgccccctctcctccccccgcccccccccggctccatcctccgccgccgcccgagcagctgcggggccgccaccgccgccgccgccgttgcaggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaata

SEQ ID NO: 647 - RNA, 1734 nt, Homo sapiens
  source 1..1734: mol_type = unassigned RNA; note = Homo sapiens AKT serine/threonine kinase 3 (AKT3), transcript variant 2, mRNA, NCBI Reference Sequence: NM_181690.2
gctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataataaaaatcggcttcctacagccagcagcacagtcacccatggaactgttggctttggattaaatgtggaattgaacgactacccagaagtgttctggaaagaagcgagatgtgtggcctgcctcaccgtcctcacccatcaaaagcaccagcaggcacgttaactcgaattctcacaaggaaaaggccattaaagctcaaggtgcatttcaaactccaggctac

SEQ ID NO: 648 - RNA, 1570 nt, Homo sapiens
  source 1..1570: mol_type = unassigned RNA; note = Homo sapiens AKT serine/threonine kinase 3 (AKT3), transcript variant 3, mRNA, NCBI Reference Sequence: NM_001206729.2
ctcaaatacacatcaccaaacaaattttctctattatttgggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataataaaaagtaagtttcaata

SEQ ID NO: 649 - RNA, 7108 nt, Homo sapiens
  source 1..7108: mol_type = unassigned RNA; note = Homo sapiens AKT serine/threonine kinase 3 (AKT3), transcript variant 4, mRNA, NCBI Reference Sequence: NM_001370074.1
attgggcaccgcccacttcgtgggcttccaggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaata

SEQ ID NO: 650 - RNA, 4456 nt, Homo sapiens
  source 1..4456: mol_type = unassigned RNA; note = Homo sapiens AKT serine/threonine kinase 3 (AKT3), transcript variant X5, mRNA, NCBI Reference Sequence: XM_011544014.2
gccactgtgcctagcctgtgttttgttacttaaaataaattattgcatattgaaaagtatttttaatgcagtcattgagccaacagaaatgttttatggggttccactcttgaactttgttcttttctttaaaatacagtgttttttagaagagcccacatcatgacaatttacaaataagccattaaactcttcatgttttaagaaaagatgagttcatttattcaattcttatgggttggtatttctttattacaaagaactgcaaaagaggatatcgccttaccttacaaaataagatttaggtttgatttacaagcaccaccaaaaaacatttctttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtt

SEQ ID NO: 651 - RNA, 5221 nt, Homo sapiens
  source 1..5221: mol_type = unassigned RNA; note = Homo sapiens AKT serine/threonine kinase 3 (AKT3), transcript variant X3, mRNA, NCBI Reference Sequence: XM_016999985.1
catcctccgccgccgcccgagcagctgcggggccgccaccgccgccgccgccgttgcaggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaagtactgaggggaaaaaagaaggaaataaggaaaccaacctttctttgagcgttactatgtatcaagccctttcacatatgttttctcattttatcttcacaacaacactgtgagaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtt

SEQ ID NO: 652 - RNA, 1361 nt, Homo sapiens
  source 1..1361: mol_type = unassigned RNA; note = Homo sapiens AKT serine/threonine kinase 3 (AKT3), transcript variant X2, mRNA, NCBI Reference Sequence: XM_024446000.1
accatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctctttttagagaacgtgtaatttcattaccttttgacaatgccttttagacttcactagggagc

SEQ ID NO: 653 - RNA, 1067 nt, Homo sapiens
  source 1..1067: mol_type = unassigned RNA; note = Homo sapiens AKT serine/threonine kinase 3 (AKT3), transcript variant X4, mRNA, NCBI Reference Sequence: XM_024446892.1
accatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagggttggtatttctttattacaaagaactgcaaaagaggatatcgccttaccttacaaaataagatttaggtttgatttacaagcaccaccaaaaaacatttctttggagaatctaatgctggacaaagatggccacataaaaattacagattttggactttgcaaagaagggatcacagatgcagccaccatgaagacattctgtggcac

SEQ ID NO: 654 - RNA, 1281 nt, Homo sapiens
  source 1..1281: mol_type = unassigned RNA; note = Homo sapiens AKT serine/threonine kinase 3 (AKT3), transcript variant X6, mRNA, NCBI Reference Sequence: XM_024447938.1
accatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagatggagtttcgctctgtcgtcaggctggagtgcagcagcacaatctaagcttactaccacctctgcctcccgggttcaagcgattctcctgcctcagccccccgagtagttgagactacaggcgcgcaccgccacacccagctaatttttgtatttttagtagagatggggtttcaccatgttggccaggatggtctcgatctcctgaccttgtgatccatctgcctcagcctcccaaagtgctgggattacaggcgtgagccaccacgccgggcctaccatgactatatttaagagactgacaatattttggagataaatttaatatttttattagcacatttcactcattcctttattccttctcctttctcttccttggttttgatcacagtcaatgtgagggaaaagtaaatttactggaaaagctaactggaaatatttttattgtgggctttctgaaataaatttaattattaaatagggtcttgtttgtgtctcatgaacttaaaatattcttattttccaaaataaataattaaatatc

SEQ ID NO: 655 - RNA, 6813 nt, Homo sapiens
  source 1..6813: mol_type = unassigned RNA; note = Homo sapiens platelet and endothelial cell adhesion molecule 1 (PECAM1), mRNA, NCBI Reference Sequence: NM_000442.5
ggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgcagatctgtgaaatgttgtcttctgaggggccacatgcatctatagtgctgaggactccttgggcctctgaagtcacagagagaaccgagcaggtctatgtttttgttttgttgttttgagacggagattcgctcttgttgcccgggctggactgcagcggcgcaacctctgctcactgcaacctccgcctcctgggttcaagcagttctcctgtctcagcctcccgagtagctgggattacaggcacatgtcaccacgcctggctaatttttgtatttttagtagagatggggtttcaccacgttggccaggctgatctcgaatgcctgacctttggtgatctgcccgccttgtcctcatgtgtgctccacaggcctttgggttgggattgcaggcgtgagccaccatgcccagcctagactcttttgacaatatgatgaaagctgttggttcctttccccaacacacacacaccgagttgtatcacgaaaatgtcatacaatttccaggttttctgagtggtgggctcagattgaggtcaaaggatcagacgacctctaacgaccttcatgtctctgttgatgatctggggacagccagatcccctgtgtccagggagttccttagtcccttgccaccaccagagaagggcaattgccacgggagctgcaaagaccctattcctactcctggtgccttacttatgcagcacgactgaattttttgttttgttttgttttgttgagacaggggcttgctctgttgcccaggctggagtgcagtggcacaacaatggctcaccgcagcctcgaacccctgggctcaagcgatcctcccatctcagcttcctgggtagctgggaccagaggcgtgagccgccatagctggctaatttttaattttttttttgcagagatgaggtttcaccatggtgcccaggctggtctcgaacttctgggctcaagtgatcctccctccttggcctcgcaaagtgctgggattgcaggcatgagccaccgcccccggcctgtggagcacacatgagtttaaaattactttcccttctgcctatatttccgaggaggaaacttcatgcgcagggatctttcttagtggatttaatggctaaaaggtctgtctgaatccaggacgctggctttagccttcctcggcagctgccgtaaccccggtgtctaaacctgaagcatcccaggagcacccactccaggagttttctcggccgcggaactcattagttagagcgccctcttgtgttctcatgtggtaatcggtcactgaaggacttaaaatggtccttagccaacacacagtaaaacttttccctcttctgaccccaagaggtcagccacccatttcatgagcatatactggtcgccccatcagcgttctctgattggctaactgaacccactccccgacctagactcaagacaggcgaagtgacgcttaggtcaacattcactcactaaagcaacgactgtcgggcgattttgtctcccgctggttttggaatggtgtctggagacatttttggttgtcacagctgggtgggtgtgctcccggcatctggtgggtagaaaccaagcatgctcctaaacatcctacaggcacagaaccgtctcccacgaccaagcatgatcaagtcccaaatgccaataatggccaggttgagaaactctgcacagaagcatccagttatttgtctgtttgctcaacaagcttgtgctcatcatgctctgtgttcctgacgctgtgctgggtgttggcggtgggaagattacaagagtcacatggcagctgtcctcctggaaggtacaacccagtagagatgcagactaacagagagccaattacaaagcagtgtgacaagcgtcatggtggaaaattaaaagctcaaacaagggcacatgggaggggcttccaacacagactttgggggatccaggaaggtctaagaggaaagtgggtctcaccaaagccttgaccataggcagagggtaccagtggaaaaggtggggtgaagaacattgaggacaaaaggaagaagtgcaggaaggccctgaggcaagggagtggggggtgccctggagggatggcagcagggcagtctgtcagacccaagtggcctccagccctagaagccaattagtcctcctcaaaaagctgtcactgtcccctaagaattgctgccaggctcccactggcctgactcagtctttgagagtcttaaggaggaggtctctgaaaggtacacaccaagaactctccccagcacagctgtttttaagactctccaccagcgtcattggcgtgttgggaagaaaccctctgccacagaggccagcttcagcctttgcctaacaccgcaagggcaaatggaaaggtaaacgggaaggagatgtctccccagcaggctatttgaggacagtcttccctgcagaagatctcaacctggggtccacagagtggaaatgttagagtagggagctaggcaaacatgagcaggacaggtgagggcccccacaggaatgtcaggctaccatcaggtgatggtcaggtggttgttaaactgtctctgtaaaataataattggttgcagccagctccaagcaaggacagtctctcaatagatacaaaacaccctgatctggtgatcagccgcttcccgataagatctcaggagctgggcaagcagcctggagcatgcgcaccaagaggcaaaatggcggaatttaaccagtatatgacctaccttcctctgggaacgcacgactggtaaggggaaaaatgcctcaagtgagcatgcgcgcaacttcagtaatcacactgtgcatgcgaccccttccaagtgctggcaggtcaccacatacgcggacagcctgctgcaagggaagaatcaggggagatgagacgtaaatcccagaactatgccaaatacataaaaccccaagttaagggtcaggcagggcacttagatctctcaagttgcctgcctgacccaagtgtagtgtacttccttttgttcctgctctaaaactttttaataaactctcactcctgctctaaaa

SEQ ID NO: 656 - RNA, 4006 nt, Homo sapiens
  source 1..4006: mol_type = unassigned RNA; note = Homo sapiens platelet and endothelial cell adhesion molecule 1 (PECAM1), transcript variant X4, mRNA, NCBI Reference Sequence: XM_005276880.1
ccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgca

SEQ ID NO: 657 - RNA, 3972 nt, Homo sapiens
  source 1..3972: mol_type = unassigned RNA; note = Homo sapiens platelet and endothelial cell adhesion molecule 1 (PECAM1), transcript variant X6, mRNA, NCBI Reference Sequence: XM_005276881.1
ccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgca

SEQ ID NO: 658 - RNA, 3966 nt, Homo sapiens
  source 1..3966: mol_type = unassigned RNA; note = Homo sapiens platelet and endothelial cell adhesion molecule 1 (PECAM1), transcript variant X7, mRNA, NCBI Reference Sequence: XM_005276882.1
ccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgca

SEQ ID NO: 659 - RNA, 2985 nt, Homo sapiens
  source 1..2985: mol_type = unassigned RNA; note = Homo sapiens platelet and endothelial cell adhesion molecule 1 (PECAM1), transcript variant X9, mRNA, NCBI Reference Sequence: XM_005276883.2
ccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagatctaggaaagaaggacacagagacagtgtacagtgaagtccggaaagctgtccctgagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctca

SEQ ID NO: 660 - RNA, 3759 nt, Homo sapiens
  source 1..3759: mol_type = unassigned RNA; note = Homo sapiens platelet and endothelial cell adhesion molecule 1 (PECAM1), transcript variant X2, mRNA, NCBI Reference Sequence: XM_011524889.2
tacataactgtttagcacccgagtatttgcatgaagagtttcatttcattttttcaagtggaaccatggaggagagtggctgcccaaggtggggtttgtcttttgccgtctgagtggcccctgggatgcagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgca

SEQ ID NO: 661 - RNA, 3708 nt, Homo sapiens
  source 1..3708: mol_type = unassigned RNA; note = Homo sapiens platelet and endothelial cell adhesion molecule 1 (PECAM1), transcript variant X1, mRNA, NCBI Reference Sequence: XM_011524890.1
gctttttctgtgcagttaacgagtcgctatgtttcggatctgcgttacttccccggtatttgaaggcaggagcactgcagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgca

SEQ ID NO: 662 - RNA, 3652 nt, Homo sapiens
  source 1..3652: mol_type = unassigned RNA; note = Homo sapiens platelet and endothelial cell adhesion molecule 1 (PECAM1), transcript variant X3, mRNA, NCBI Reference Sequence: XM_017024738.1
aagctcagcctgccccagcagcagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgca

SEQ ID NO: 663 - RNA, 3975 nt, Homo sapiens
  source 1..3975: mol_type = unassigned RNA; note = Homo sapiens platelet and endothelial cell adhesion molecule 1 (PECAM1), transcript variant X5, mRNA, NCBI Reference Sequence: XM_017024739.1
ccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacgagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgca

SEQ ID NO: 664 - RNA, 3665 nt, Homo sapiens
  source 1..3665: mol_type = unassigned RNA; note = Homo sapiens platelet and endothelial cell adhesion molecule 1 (PECAM1), transcript variant X8, mRNA, NCBI Reference Sequence: XM_017024740.1
gtttcatttcattttttcaagtggaaccatggaggagagtggctgcccaaggtggggtttgtcttttgccgtctgagtggcccctgggatgcagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgca

SEQ ID NO: 665 - RNA, 3918 nt, Homo sapiens
  source 1..3918: mol_type = unassigned RNA; note = Homo sapiens platelet and endothelial cell adhesion molecule 1 (PECAM1), transcript variant X10, mRNA, NCBI Reference Sequence: XM_017024741.1
ccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacgagcctctgaactcagacgtgcagtacacggaagttcaagtgtcctcagctgagtctcacaaagatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgca

SEQ ID NO: 666 - RNA, 3349 nt, Homo sapiens
  source 1..3349: mol_type = unassigned RNA; note = Homo sapiens Kruppel like factor 5 (KLF5), transcript variant 1, mRNA, NCBI Reference Sequence: NM_001730.5
agtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaacaaaagcaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaaga

SEQ ID NO: 667 - RNA, 2948 nt, Homo sapiens
  source 1..2948: mol_type = unassigned RNA; note = Homo sapiens Kruppel like factor 5 (KLF5), transcript variant 2, mRNA, NCBI Reference Sequence: NM_001286818.2
actttagctcagacctttcttttaaccttgcctatcatgtttcgagtcagaatttaaatactgtgcagtttaagctacaatacgcttggcctataacttggttccaggcatttatatttatgtcacttttgtctacttattatactaacaaggtggaaaaagcaatcccagtctctccaaaagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaacaaaagcaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaaga

SEQ ID NO: 668 - RNA, 6230 nt, Homo sapiens
  source 1..6230: mol_type = unassigned RNA; note = Homo sapiens plexin domain containing 1 (PLXDC1), mRNA, NCBI Reference Sequence: NM_020405.5
gctcccggaggccgcagcctccagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaactccttgtctctcaacgtattggctatgacgcagcaagcagaatgaatttggactcagttacaggctgtcaatggtctgctctgtagcagtctcagagcctccccgacccactacctggagatagccagatagccagatgccctgctcctggccacctttaaagcccctgcatatgacacaggttaactaaagtcaagattggggctgctgcattccaggttccctagactcacaagctggtccttggccaggtgcagtggctcacgcctgtaatcccagcactttgggaggctgaggcaggcggatcacctgaagtcagaagtttgagaccagcctggccaacataattaaaatgtctctactaaaaatacaaaaaattagctgggtgtggtgacgcttgcctgtatcccagctactcaggaagctgagacacgagaatcacttgaacctgggaggcagaggttgcagtgagctcagatagtgccactgcactccagcctgggtgacagagcgagactccgtctcaaaaaaaaaaaaagaaagcagatcctcatggctatagagttggcattttagccccagcttctgtagctctgaaagcctaaagaaggtattctctccatctgttaaacacagtatagtggctctcagcccttggggcatgttatcatgggagggaagtcaaataagaggagagaaaagaactcaagggggaaactgcatttttaggctttgctctcttaccttgccctttctactcagaaccaataacttctgcatcaaaacatgttacagcctgcatcaagggctttaccccaacctgcagcccagccttccctgggtgagcttgctatgcgcagccacatttaccatgtggggctccctattctgatggcctgttcggtgccgggtttactcactgccctgttctgatgtcagtgcctgtacatacctccaaaggcaggacttgcctgataaatatttttcctcctctgaactggattttataggcattaaagacaagtcgggtggctagagggctccttgagacatacctagcagggaactgcaggtggattctgttgagaggcaaagcacctgagtggttgggacacaggcagctggcatgggagggactttttttgagacagggtctcactgtgtcgcccagggcaaggatgcccaaagacaccaggttggagaggcacctgccaactacttgctttccctggagcctgcatgtgcctgtggggtggggaggcgtaggggtctacggctgcctgagatgggtgtgcacagtgtgtgaagtacctacctccttgccttgctggactgtcagccagtcgcagggccggccacaagacccatgtctccatctggtcatactccatagctaccaagttaacctgctctaaactttggagaactggatctgtccaataaacgcttatttggccaagcctgatggctcgtgcctgtactcccagcactttgggaggctgaggtgggagggttgcttgagcccaggggtttgagaccagcttgggcaacaacaacaaaaatgccaggtgtggtggggtgcacctgtagtcccagctactagggaggctgagccaggaggatcacttgagcccgggaggttgaggctgcagtggggggtcataatcatgccactgtactccagcctgggtgacagagtgagaccctgtctccgaaaaaaaaaaaaaaaaaaagaacggaaaaagaaatgcttacattgtcagggatcctgtagacaatcattaactctatgagatgcttggttctatttttttgggagactttgtccaagtgttttggcttaagaaatccataggcctctcttggtgacacatctctagtactttttgtcataaacaaacaggccatctgccgccaaatacatccactccccatgccactgacatcctatgggtcagccaggcttgctttgactgaggccgaggcatctggaactttctctgcctgcaggggctagcagcagaggcttcaccgcatcaccaccccttcctccactcctgacattctttcccttcagggatccaaaatggttggccgagctcccagtgggaaaacgtgtgctagagttggggagtgagatgagtggtgctgtccatggaatcaggccacagcaggaactgccccactggccatttgagacacacacaggtggtaaatgctctgctggtgggctgtgcttccctcattcagagagctctgttacagcccactgtgtcctttagaagcttgaaaggaacccaactctttgctgcactgtcctttttcttcctcaaattcagaccctccttccaccggcacccccctactccaccctcagctcttccttgcctggtttatcaagcagagctgaggccccacgtttccaactctgattgtcacttgcatcttcacaaaggataaaccacggagcaactggaaaaccatcagccaagcgttcggatgagtctggttattggtccacccccgaccagattcccttacacttaactcacttctttctttggcaatgaccctcatgacatgtataaatgggtatgactaagaagaggctgtgatctaacatttatttgctgccattttttactctggggagaagcagccccaactcatcactgggaaagaactccccctgcaaaccagctaaatttgataatttaaaccccctgcccctaaaacttctcacagagctggggagttggtggcaactttccaagtcaaggtcttgcttagaaagtccttcactacatggccaggtgcagtggctcacgcctgtagtcccaggtacttgggagcctgaggcaggaggattgcttgagctcaggagttcaaggctgcagagagctatgatcatcccactgcatttgtttaaaaataaatttttaaaatttgtgtgttttatcaggggtctcctgtacagtgtatctgtgtatgtttgtgtgtgtgtttgtatacagccttgtttaatgttttgagcaataagatatgcacacacaggtattttgttgctaaagagattggacaaggttgtagctgtgctcaggcttcagcttggtttgttaaattgagagataaacaatgacaagagctgccagccaaccacactattcaaaaagcaaagtgttcaccactaaagctaaccattcatctggttgcaggcaaggctaaggctctctctcctctagttcctggaacagactcacagattggcatgaagcactgatcaggggctgcactcagactccctggccaagcaaacctacaccagaagagtcagtgtcacagatatgatgcggccaatctctgtctccaaaaacctacctgaacttaatggtagaattcaaagatctggggactgagggcacccagccttctaaaacacaatgtattcatgtgtttagtgtaaactctctgcatggattctcagtgttaataataaaaggaagcattcttttacaactcctgctgtgtgcaaaagaaagtgcaaaggatttggagtggcattccgaagatcaccacacataccttggttctgatggctgctgaactccgacttcttcgctgagacatgactgtgggaacagcctccagctatctgctcatcagaggtgctttcctcaacctcctgcaccacctccaagagaaacagcctaaaaagaaaccccagctgtttacttatattggtctgtaaatccctggaagtaaaccccatgcatttttatctactgtctgaggacatacaataaatctgagaaagtc

SEQ ID NO: 669 - RNA, 8728 nt, Homo sapiens
  source 1..8728: mol_type = unassigned RNA; note = Homo sapiens ubiquitin protein ligase E3A (UBE3A), transcript variant 3, mRNA, NCBI Reference Sequence: NM_130839.5
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 670 - RNA, 5319 nt, Homo sapiens
  source 1..5319: mol_type = unassigned RNA; note = Homo sapiens ubiquitin protein ligase E3A (UBE3A), transcript variant 2, mRNA, NCBI Reference Sequence: NM_000462.5
gctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaaatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttca

SEQ ID NO: 671 - RNA, 8544 nt, Homo sapiens
  source 1..8544: mol_type = unassigned RNA; note = Homo sapiens ubiquitin protein ligase E3A (UBE3A), transcript variant 1, mRNA, NCBI Reference Sequence: NM_130838.4
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 672 - RNA, 4863 nt, Homo sapiens
  source 1..4863: mol_type = unassigned RNA; note = Homo sapiens ubiquitin protein ligase E3A (UBE3A), transcript variant 4, mRNA, NCBI Reference Sequence: NM_001354505.1
ggggcggggcgggacgtgcgaggcgtcgagatttgggcctcctaggagccaggctcttcgagccagccggggccccagacagggaagggcaggccctttccttcaaaggggagccctttctcggcgttttcaaggtttttggctctcttggggaagacatatttagccgtgtgcttggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttca

SEQ ID NO: 673 - RNA, 8864 nt, Homo sapiens
  source 1..8864: mol_type = unassigned RNA; note = Homo sapiens ubiquitin protein ligase E3A (UBE3A), transcript variant 5, mRNA, NCBI Reference Sequence: NM_001354506.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaactcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 674 - RNA, 8960 nt, Homo sapiens
  source 1..8960: mol_type = unassigned RNA; note = Homo sapiens ubiquitin protein ligase E3A (UBE3A), transcript variant 6, mRNA, NCBI Reference Sequence: NM_001354507.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagggtaaataccttaaattggaattactgggtcacatggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 675 - RNA, 8924 nt, Homo sapiens
  source 1..8924: mol_type = unassigned RNA; note = Homo sapiens ubiquitin protein ligase E3A (UBE3A), transcript variant 7, mRNA, NCBI Reference Sequence: NM_001354508.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 676 - RNA, 9037 nt, Homo sapiens
  source 1..9037: mol_type = unassigned RNA; note = Homo sapiens ubiquitin protein ligase E3A (UBE3A), transcript variant 8, mRNA, NCBI Reference Sequence: NM_001354509.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaagtgagccaccatttgaatttgctagctcatgctgcagtattcagattatgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 677 - RNA, 8874 nt, Homo sapiens
  source 1..8874: mol_type = unassigned RNA; note = Homo sapiens ubiquitin protein ligase E3A (UBE3A), transcript variant 10, mRNA, NCBI Reference Sequence: NM_001354511.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 678 - RNA, 8890 nt, Homo sapiens
  source 1..8890: mol_type = unassigned RNA; note = Homo sapiens ubiquitin protein ligase E3A (UBE3A), transcript variant 11, mRNA, NCBI Reference Sequence: NM_001354512.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 679 - RNA, 8894 nt, Homo sapiens
  source 1..8894: mol_type = unassigned RNA; note = Homo sapiens ubiquitin protein ligase E3A (UBE3A), transcript variant 12, mRNA, NCBI Reference Sequence: NM_001354513.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 680 - RNA, 8841 nt, Homo sapiens
  source 1..8841: mol_type = unassigned RNA; note = Homo sapiens ubiquitin protein ligase E3A (UBE3A), transcript variant 9, mRNA, NCBI Reference Sequence: NM_001354523.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatacacaggagcccatgaaaggcatcacgtgtggaaggaagtgacacgagtcatagtctgccctgcttttctaccacctgaagcatcatataaacctatatcttctgtttcaaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 681 - RNA, 5124 nt, Homo sapiens
  source 1..5124: mol_type = unassigned RNA; note = Homo sapiens ubiquitin protein ligase E3A (UBE3A), transcript variant 13, mRNA, NCBI Reference Sequence: NM_001354526.1
ggggcggggcgggacgtgcgaggcgtcgagatttgggcctcctaggagccaggctcttcgagccagccggggccccagacagggaagggcaggccctttccttcaaaggggagccctttctcggcgttttcaaggtttttggctctcttggggaagacatatttagccgtgtgcttggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaatgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttca

SEQ ID NO: 682 - RNA, 8764 nt, Homo sapiens
  source 1..8764: mol_type = unassigned RNA; note = Homo sapiens ubiquitin protein ligase E3A (UBE3A), transcript variant 14, mRNA, NCBI Reference Sequence: NM_001354538.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagggtaaataccttaaattggaattactgggtcacatggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 683 - RNA, 8799 nt, Homo sapiens
  source 1..8799: mol_type = unassigned RNA; note = Homo sapiens ubiquitin protein ligase E3A (UBE3A), transcript variant 15, mRNA, NCBI Reference Sequence: NM_001354539.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 684 - RNA, 9154 nt, Homo sapiens
  source 1..9154: mol_type = unassigned RNA; note = Homo sapiens ubiquitin protein ligase E3A (UBE3A), transcript variant 16, mRNA, NCBI Reference Sequence: NM_001354540.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagagactgccatactgttttccacagtgactgcaccattttacattcccaccagcagtgaataagggttccaatttctctgcatcttttctaacacttgaggggaggtatggtgtcaagaaaacatagtcaccattattacgaaaagtaaaatatggaagagatgatccctaccatcaatcagcttacaactagaggcactgacaaatgtatacagatagctgtaatgtaaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 685 - RNA, 8989 nt, Homo sapiens
  source 1..8989: mol_type = unassigned RNA; note = Homo sapiens ubiquitin protein ligase E3A (UBE3A), transcript variant 17, mRNA, NCBI Reference Sequence: NM_001354541.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaatgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 686 - RNA, 8608 nt, Homo sapiens
  source 1..8608: mol_type = unassigned RNA; note = Homo sapiens ubiquitin protein ligase E3A (UBE3A), transcript variant 18, mRNA, NCBI Reference Sequence: NM_001354542.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 687 - RNA, 9169 nt, Homo sapiens
  source 1..9169: mol_type = unassigned RNA; note = Homo sapiens ubiquitin protein ligase E3A (UBE3A), transcript variant 19, mRNA, NCBI Reference Sequence: NM_001354543.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagagactgccatactgttttccacagtgactgcaccattttacattcccaccagcagtgaataagggttccaatttctctgcatcttttctaacacttgaggggaggtatggtgtcaagaaaacatagtcaccattattacgaaaagtaaaatatggaagagatgatccctaccatcaatcagcttacaactagaggcactgacaaatgtatacagatagctgtaatgtaaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaatatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 688 - RNA, 8955 nt, Homo sapiens
  source 1..8955: mol_type = unassigned RNA; note = Homo sapiens ubiquitin protein ligase E3A (UBE3A), transcript variant 20, mRNA, NCBI Reference Sequence: NM_001354544.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaactctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 689 - RNA, 8572 nt, Homo sapiens
  source 1..8572: mol_type = unassigned RNA; note = Homo sapiens ubiquitin protein ligase E3A (UBE3A), transcript variant 21, mRNA, NCBI Reference Sequence: NM_001354545.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaagaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 690 - RNA, 8502 nt, Homo sapiens
  source 1..8502: mol_type = unassigned RNA; note = Homo sapiens ubiquitin protein ligase E3A (UBE3A), transcript variant 22, mRNA, NCBI Reference Sequence: NM_001354546.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 691 - RNA, 8768 nt, Homo sapiens
  source 1..8768: mol_type = unassigned RNA; note = Homo sapiens ubiquitin protein ligase E3A (UBE3A), transcript variant 23, mRNA, NCBI Reference Sequence: NM_001354547.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaagaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 692 - RNA, 8388 nt, Homo sapiens
  source 1..8388: mol_type = unassigned RNA; note = Homo sapiens ubiquitin protein ligase E3A (UBE3A), transcript variant 24, mRNA, NCBI Reference Sequence: NM_001354548.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaagaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 693 - RNA, 8379 nt, Homo sapiens
  source 1..8379: mol_type = unassigned RNA; note = Homo sapiens ubiquitin protein ligase E3A (UBE3A), transcript variant 25, mRNA, NCBI Reference Sequence: NM_001354549.2
agtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

(The sequence listing continues in the following parts.)

What is claimed is:

1. A therapeutic compound for red blood cell-mediated (RBC-mediated) delivery in a mammalian subject to a fibrotic cell expressing CD47, the therapeutic compound comprising:
 a CD47-binding protein conjugated to an active pharmaceutical ingredient (API) so as to form a conjugate;
 wherein:
 the CD47-binding protein is selected from the group consisting of wild type thrombospondin-1 (TSP-1) (SEQ ID NO: 7), wild type SIRPγ (SEQ ID NO: 4), vSIRPγ-1 (SEQ ID NO: 5), vSIRPγ-2 (SEQ ID NO: 6), ALX148 (SEQ ID NO: 962), TTI-661 (SEQ ID NO: 963), TTI-662 (SEQ ID NO: 964), a homolog of any of the foregoing, and combinations thereof, and is configured to bind the conjugate to CD47 of a red blood cell of the subject so as to enable transport of the conjugate, through the subject's circulatory system, to the fibrotic cell, so that (i) the CD47-binding protein, being configured to bind the conjugate to the CD47 of the red blood cell, binds the CD47 of the fibrotic cell, thus transferring the conjugate from the red blood cell to the fibrotic cell so as to form a conjugate-CD47 complex on the fibrotic cell, thereby blocking CD47 and inhibiting CD47 activity as an immune escape mechanism of the fibrotic cell, and (ii) the conjugate is taken up by the fibrotic cell via endocytosis of the conjugate-CD47 complex, thereby further inhibiting the immune escape mechanism of the fibrotic cell and delivering the API into the fibrotic cell; and
 the API is siRNA, the siRNA being a double-stranded RNA molecule including an antisense RNA strand and a sense RNA strand,
 wherein:
 (a) the antisense RNA strand is 19-29 nucleotides in length and is complementary to contiguous nucleotides in a target mammalian mRNA sequence, the mRNA sequence being selected from the group consisting of SEQ ID NO: 8-21, 40-43, and 766-770,
 (b) the sense RNA strand is 19-29 nucleotides in length and is complementary to 14-29 nucleotides from the antisense RNA strand, and
 (c) the double stranded RNA molecule has a double stranded region of 14-29 nucleotides in length and a 3' overhang region of 0-5 nucleotides in length.

2. The therapeutic compound of claim 1, wherein the CD47-binding protein is conjugated to the API by a linker.

3. The therapeutic compound according to claim 2, wherein the linker is cleavable.

4. The therapeutic compound of claim 1, wherein the fibrotic cell is associated with cystic fibrosis.

5. A therapeutic compound for RBC-mediated delivery in a mammalian subject to a fibrotic cell expressing CD47, the therapeutic compound comprising:
 a CD47-binding protein conjugated to an API so as to form a conjugate;
 wherein:
 the CD47-binding protein is selected from the group consisting of wild type thrombospondin-1 (TSP-1) (SEQ ID NO: 7), wild type SIRPγ (SEQ ID NO: 4), vSIRPγ-1 (SEQ ID NO: 5), vSIRPγ-2 (SEQ ID NO: 6), ALX148 (SEQ ID NO: 962), TTI-661 (SEQ ID NO: 963), TTI-662 (SEQ ID NO: 964), a homolog of any of the foregoing, and combinations thereof, and is configured to bind the conjugate to CD47 of a red blood cell of the subject so as to enable transport of the conjugate, through the subject's circulatory system, to the fibrotic cell, so that (i) the CD47-binding protein, being configured to bind the conjugate to the CD47 of the red blood cell, binds the CD47 of the fibrotic cell, thus transferring the conjugate from the red blood cell to the fibrotic cell so as to form a conjugate-CD47 complex on the fibrotic cell, thereby blocking CD47 and inhibiting CD47 activity as an immune escape mechanism of the fibrotic cell, and (ii) the conjugate is taken up by the fibrotic cell via endocytosis of the conjugate-CD47 complex, thereby further inhibiting the immune escape mechanism of the fibrotic cell and delivering the API into the fibrotic cell; and
 the API is shRNA, the shRNA being a single-stranded RNA molecule of 44-71 nucleotides in length, and having, in a 5' to 3' direction:
 a first region of 19-29 nucleotides at the 5' end of the single-stranded RNA molecule, the first region having a first sequence;
 a second region of 4-11 nucleotides directly adjacent to the first region, the second region having a second sequence;
 a third region of 19-29 nucleotides directly adjacent to the second region, the third region having a third sequence; and
 a fourth region of 2 nucleotides at the 3' end of the single-stranded RNA molecule, directly adjacent to the third region, the fourth region having a fourth sequence,
 wherein:
 (a) the first region has the same number of nucleotides as the third region,
 (b) the third sequence is the reverse-complement of the first sequence,
 (c) the third region is complementary to contiguous nucleotides in a target mammalian mRNA sequence, the mRNA sequence being selected from the group consisting of SEQ ID NO: 8-21, 40-43, and 766-770, and
 (d) the single-stranded RNA molecule is configured to form a stem loop structure, the first region base pairing with the third region to form a stem, the second region forming a loop, and the fourth region forming a 3' overhang.

6. The therapeutic compound of claim 5, wherein the CD47-binding protein is conjugated to the API by a linker.

7. The therapeutic compound of claim 6, wherein the linker is cleavable.

8. The therapeutic compound of claim 5, wherein the fibrotic cell is associated with cystic fibrosis.

* * * * *